US011865145B2

(12) United States Patent
Santiago et al.

(10) Patent No.: US 11,865,145 B2
(45) Date of Patent: Jan. 9, 2024

(54) COMPOSITIONS AND METHODS FOR MAINTAINING AND RESTORING A HEALTHY GUT BARRIER

(71) Applicant: Finch Therapeutics Holdings LLC, Somerville, MA (US)

(72) Inventors: Marina Santiago, Somerville, MA (US); Kevin Roelofs, Somerville, MA (US)

(73) Assignee: Finch Therapeutics Holdings LLC, Boston, MA (US)

( * ) Notice: Subject to any disclaimer, the term of this patent is extended or adjusted under 35 U.S.C. 154(b) by 0 days.

(21) Appl. No.: 16/636,828

(22) PCT Filed: Aug. 7, 2018

(86) PCT No.: PCT/US2018/045593

§ 371 (c)(1),
(2) Date: Feb. 5, 2020

(87) PCT Pub. No.: WO2019/032573

PCT Pub. Date: Feb. 14, 2019

(65) Prior Publication Data

US 2020/0368295 A1 Nov. 26, 2020

Related U.S. Application Data

(60) Provisional application No. 62/542,035, filed on Aug. 7, 2017.

(51) Int. Cl.

| | |
|---|---|
| ***A61K 35/741*** | (2015.01) |
| ***A61K 9/00*** | (2006.01) |
| ***A61K 9/48*** | (2006.01) |
| ***A61K 45/06*** | (2006.01) |

(52) U.S. Cl.
CPC .......... *A61K 35/741* (2013.01); *A61K 9/0053* (2013.01); *A61K 9/48* (2013.01); *A61K 45/06* (2013.01)

(58) Field of Classification Search
CPC .................................................... A61K 35/741
See application file for complete search history.

(56) References Cited

U.S. PATENT DOCUMENTS

| | | | |
|---|---|---|---|
| 3,192,116 | A | 6/1965 | Möse et al. |
| 3,320,130 | A | 5/1967 | Henry |
| 3,713,836 | A | 1/1973 | Carlsson |
| 4,098,728 | A | 7/1978 | Rosenblatt |
| 4,196,564 | A | 4/1980 | Bodenmann et al. |
| 4,196,565 | A | 4/1980 | Bodenmann et al. |
| 4,247,006 | A | 1/1981 | Bodenmann et al. |
| 4,250,997 | A | 2/1981 | Bodenmann et al. |
| 4,268,265 | A | 5/1981 | Von Wattenwyl |
| 4,309,782 | A | 1/1982 | Paulin |
| 4,332,790 | A | 6/1982 | Sozzi et al. |
| 4,335,107 | A | 6/1982 | Snoeyenbos et al. |
| 4,394,377 | A | 7/1983 | Spires |
| 4,452,779 | A | 6/1984 | Cockerill |
| 4,536,409 | A | 8/1985 | Farrell et al. |
| 4,537,776 | A | 8/1985 | Cooper |
| 4,657,762 | A | 4/1987 | Mikkola et al. |
| 4,710,379 | A | 12/1987 | Kawai et al. |
| 4,892,731 | A | 1/1990 | Arai et al. |
| 4,975,286 | A | 12/1990 | Hechter |
| 5,213,807 | A | 5/1993 | Chemburkar et al. |
| 5,266,315 | A | 11/1993 | Taguchi et al. |
| 5,317,849 | A | 6/1994 | Sauter |
| 5,443,826 | A | 8/1995 | Borody |
| 5,599,795 | A | 2/1997 | McCann et al. |
| 5,728,380 | A | 3/1998 | Allen et al. |
| 5,800,821 | A | 9/1998 | Acheson et al. |
| 5,837,238 | A | 11/1998 | Casas et al. |
| 5,858,356 | A | 1/1999 | Wolf et al. |
| 5,902,578 | A | 5/1999 | Halpin-Dohnalek et al. |
| 5,902,743 | A | 5/1999 | Luchansky et al. |
| 6,087,386 | A | 7/2000 | Chen et al. |
| 6,162,464 | A | 12/2000 | Jacob et al. |
| 6,245,740 | B1 | 6/2001 | Goldenberg et al. |
| 6,284,274 | B1 | 9/2001 | Merrill et al. |
| 6,428,783 | B1 | 8/2002 | Khachatrian et al. |
| 6,479,051 | B1 | 11/2002 | Bruce et al. |
| 6,514,531 | B1 | 2/2003 | Alaux et al. |
| 6,572,892 | B1 | 6/2003 | Ioulalen et al. |
| 6,645,530 | B1 | 11/2003 | Borody |
| 6,649,397 | B1 | 11/2003 | Nakamura |

(Continued)

FOREIGN PATENT DOCUMENTS

| | | |
|---|---|---|
| AU | 2001276160 B2 | 3/2007 |
| CA | 1333564 | 12/1994 |

(Continued)

OTHER PUBLICATIONS

Healthline, https://www.healthline.com/health/digestive-health/dysbiosis#treatment, assessed May 24, 2021 (Year: 2021).*
Clevelandclinic.org, https://my.clevelandclinic.org/health/articles/7040-gastrointestinal-disorders, 16 pages, accessed May 26, 2021 (Year: 2020).*
CDC (https://www.cdc.gov/diabetes/basics/what-is-type-1-diabetes.html#:~: text=Currently%2C%20no%20one%20knows%20how,self%2Dmanagement%20education%20and%20support; accessed May 24, 2021) (Year: 2021).*
LeBlanc et al. Microb Cell Fact (2017) 16:79 (Year: 2017).*
www.healing with nutrition.com/idisease/inflambowel/crohns.html; Oct. 23, 2005 (Year: 2005).*

(Continued)

*Primary Examiner* — Brian Gangle
*Assistant Examiner* — Lakia J Jackson-Tongue
(74) *Attorney, Agent, or Firm* — Arnold & Porter Kaye Scholer LLP

(57) ABSTRACT

The present invention relates to, in part, compositions and methods for delivery of novel mixtures of bacterial strains for maintaining and/or restoring a healthy gut barrier.

15 Claims, 1 Drawing Sheet

Specification includes a Sequence Listing.

(56) References Cited

U.S. PATENT DOCUMENTS 6,756,032 B1 6/2004 Tepper et al.
6,926,907 B2 8/2005 Plachetka
6,979,674 B1 12/2005 Goldenberg et al.
6,984,513 B2 1/2006 Brown et al.
7,018,629 B2 3/2006 Jacob et al.
7,374,753 B1 5/2008 Farmer et al.
7,541,091 B2 6/2009 Sisson et al.
7,712,634 B2 5/2010 MacMichael et al.
7,749,509 B2 7/2010 Cobb et al.
7,763,276 B1 7/2010 Shodai et al.
7,799,328 B2 9/2010 Hublot et al.
7,799,341 B2 9/2010 Porzio et al.
7,815,956 B2 10/2010 Lee et al.
7,845,475 B2 12/2010 Shiraishi et al.
7,888,062 B1 2/2011 Garner et al.
7,998,510 B2 8/2011 Caswell
8,074,835 B2 12/2011 MacMichael et al.
8,168,171 B2 5/2012 Mogna et al.
8,398,912 B2 3/2013 Goossens et al.
8,440,224 B2 5/2013 Clarke et al.
8,460,648 B2 6/2013 Borody
8,535,713 B2 9/2013 Coulter
8,557,294 B2 10/2013 Scott et al.
8,586,029 B2 11/2013 Kasper et al.
8,637,297 B2 1/2014 Vieites Fernandez et al.
8,646,591 B2 2/2014 De Ruijter et al.
8,658,153 B2 2/2014 Daube et al.
8,739,812 B2 6/2014 Brandon-Jones et al.
8,771,673 B2 7/2014 Cobb et al.
8,810,259 B2 8/2014 Herrmann et al.
8,852,631 B2 10/2014 Cade et al.
8,911,777 B2 12/2014 Coulter
8,911,788 B2 12/2014 Ioualalen et al.
9,040,036 B2 5/2015 Borody
9,050,358 B2 6/2015 Borody
9,308,226 B2 4/2016 Borody
9,320,763 B2 4/2016 Borody
9,408,872 B2 8/2016 Borody
9,468,658 B2 10/2016 Borody
9,572,841 B2 2/2017 Borody
9,572,842 B2 2/2017 Borody
9,610,308 B2 4/2017 Borody
9,623,056 B2 4/2017 Borody
9,682,108 B2 6/2017 Borody
9,719,144 B2 8/2017 Krajmalnik-Brown et al.
9,737,574 B2 8/2017 Borody
9,789,140 B2 10/2017 Borody
9,867,858 B2 1/2018 Borody
9,901,603 B2 2/2018 Borody
9,901,604 B2 2/2018 Borody
9,962,413 B2 5/2018 Borody
9,962,414 B2 5/2018 Borody
9,968,638 B2 5/2018 Sadowsky et al.
10,022,406 B2 7/2018 Borody
10,028,980 B2 7/2018 Sadowsky et al.
10,064,899 B1 9/2018 Borody
10,092,601 B2 10/2018 Borody
10,195,235 B2 2/2019 Borody
10,251,914 B2 4/2019 Sadowsky et al.
10,278,997 B2 5/2019 Borody
10,286,011 B2 5/2019 Sadowsky et al.
10,286,012 B2 5/2019 Sadowsky et al.
10,328,107 B2 6/2019 Borody
10,369,175 B2 8/2019 Borody
10,463,702 B2 11/2019 Borody
2001/0014322 A1 8/2001 Chen et al.
2002/0013270 A1 1/2002 Bolte
2002/0022019 A1 2/2002 Laulund
2002/0039599 A1 4/2002 Lin et al.
2003/0092163 A1 5/2003 Collins et al.
2003/0092724 A1 5/2003 Kao et al.
2003/0147858 A1 8/2003 Renaud et al.
2004/0062757 A1 4/2004 Finegold
2004/0167062 A1 8/2004 Bolte
2004/0170617 A1 9/2004 Finegold
2004/0223956 A1 11/2004 Naidu et al.
2006/0076536 A1 4/2006 Barshied
2006/0099197 A1 5/2006 Farmer
2006/0115465 A1 6/2006 Macfarlane et al.
2006/0177424 A1 8/2006 Cobb et al.
2006/0275223 A1 12/2006 Burr
2007/0059296 A1 3/2007 Chen
2007/0196341 A1* 8/2007 Uchida .................. A61K 35/74
424/93.4
2007/0292523 A1 12/2007 Moodley et al.
2008/0020018 A1 1/2008 Moodley et al.
2008/0113031 A1 5/2008 Moodley et al.
2008/0254009 A1 10/2008 Finegold
2008/0299197 A1 12/2008 Toneguzzo et al.
2010/0112003 A1 5/2010 Collins et al.
2010/0178349 A1 7/2010 Kolter et al.
2010/0178413 A1 7/2010 Gorris
2010/0184785 A1 7/2010 Kolter et al.
2010/0203120 A1 8/2010 Coulter
2010/0222311 A1 9/2010 Thommes et al.
2010/0226866 A1 9/2010 Yamashiro et al.
2010/0233278 A1 9/2010 Ookawa et al.
2010/0239667 A1 9/2010 Hemmingsen et al.
2010/0247489 A1 9/2010 Saur-Brosch
2010/0247665 A1 9/2010 Takahashi
2010/0255087 A1 10/2010 Coulter
2010/0255231 A1 10/2010 Chau et al.
2010/0255307 A1 10/2010 Gonze et al.
2010/0278930 A1 11/2010 Okumura et al.
2010/0285164 A1 11/2010 Schaible et al.
2010/0289164 A1 11/2010 Porzio et al.
2010/0297031 A1 11/2010 Úbeda Pérez et al.
2010/0297221 A1 11/2010 Coulter
2011/0008554 A1 1/2011 Chen et al.
2011/0045222 A1 2/2011 Peters
2011/0052645 A1 3/2011 Coulter
2011/0081320 A1 4/2011 Westall et al.
2011/0091431 A1 4/2011 Olmstead
2011/0200570 A1 8/2011 Mosbaugh et al.
2011/0218216 A1 9/2011 Vivek et al.
2012/0020941 A1 1/2012 Wacklin et al.
2012/0039853 A1 2/2012 Corveleyn et al.
2012/0064133 A1 3/2012 Chauhan et al.
2012/0087895 A1 4/2012 Mazmanian et al.
2012/0129773 A1 5/2012 Geier et al.
2012/0141531 A1 6/2012 Coulter et al.
2012/0141585 A1 6/2012 Coulter et al.
2012/0183612 A1 7/2012 Brögmann et al.
2012/0252775 A1 10/2012 Finegold
2013/0022622 A1 1/2013 Ben-Ari et al.
2013/0045274 A1 2/2013 Hlavka
2013/0184290 A1 7/2013 Padval et al.
2013/0195804 A1 8/2013 Borody
2013/0243873 A1 9/2013 Aversa et al.
2013/0259899 A1 10/2013 Allen-Vercoe et al.
2013/0287842 A1 10/2013 Cade et al.
2013/0295188 A1 11/2013 Cade et al.
2013/0307962 A1 11/2013 Humphries et al.
2013/0316394 A1 11/2013 Stimpson
2013/0330411 A1 12/2013 Coulter
2014/0017313 A1 1/2014 Coulter et al.
2014/0065132 A1 3/2014 Hsiao et al.
2014/0086877 A1 3/2014 Hlavka
2014/0088202 A1 3/2014 Cade et al.
2014/0147417 A1 5/2014 Sadowsky et al.
2014/0147425 A1 5/2014 Henn et al.
2014/0227357 A1 8/2014 Vertommen et al.
2014/0234260 A1 8/2014 Borody
2014/0234418 A1 8/2014 Coulter et al.
2014/0255351 A1 9/2014 Berstad et al.
2014/0302132 A1 10/2014 Brown
2014/0328803 A1 11/2014 McKenzie et al.
2014/0335131 A1* 11/2014 Mazmanian ........... A61K 31/59
424/282.1
2014/0341921 A1 11/2014 Honda et al.
2014/0342438 A1 11/2014 Allen-Vercoe et al.
2014/0363397 A1 12/2014 Allen-Vercoe et al.
2014/0363398 A1 12/2014 Jones et al.
2015/0044173 A1 2/2015 Jones et al.

(56) References Cited

U.S. PATENT DOCUMENTS

| | | | |
|---|---|---|---|
| 2015/0050246 | A1 | 2/2015 | Jones et al. |
| 2015/0093360 | A1 | 4/2015 | McKenzie et al. |
| 2015/0143557 | A1 | 5/2015 | Honda et al. |
| 2015/0152484 | A1 | 6/2015 | Krajmalnik-Brown et al. |
| 2015/0190435 | A1 | 7/2015 | Henn et al. |
| 2015/0224152 | A1 | 8/2015 | Littman et al. |
| 2015/0238544 | A1 | 8/2015 | Jones et al. |
| 2015/0238545 | A1 | 8/2015 | Borody |
| 2015/0238546 | A1 | 8/2015 | Borody |
| 2015/0293072 | A1 | 10/2015 | Geigenmuller et al. |
| 2015/0297642 | A1 | 10/2015 | Borody |
| 2015/0306144 | A1 | 10/2015 | Borody |
| 2015/0306155 | A1 | 10/2015 | Borody |
| 2015/0306156 | A1 | 10/2015 | Borody |
| 2015/0374761 | A1 | 12/2015 | Sadowsky et al. |
| 2016/0089363 | A1 | 3/2016 | Borody |
| 2016/0091480 | A1 | 3/2016 | Geigenmuller et al. |
| 2016/0151429 | A1 | 6/2016 | Borody |
| 2016/0151431 | A1 | 6/2016 | Borody |
| 2016/0151432 | A1 | 6/2016 | Borody |
| 2016/0151433 | A1 | 6/2016 | Borody |
| 2016/0158294 | A1 | 6/2016 | Von Maltzahn et al. |
| 2016/0193258 | A1 | 7/2016 | Berry et al. |
| 2016/0243175 | A1 | 8/2016 | Bushman et al. |
| 2016/0279178 | A1 | 9/2016 | Borody |
| 2016/0279179 | A1 | 9/2016 | Borody |
| 2016/0339065 | A1 | 11/2016 | Adams et al. |
| 2017/0216378 | A1 | 8/2017 | Honda et al. |
| 2017/0246220 | A1 | 8/2017 | Sato et al. |
| 2017/0319627 | A1 | 11/2017 | Sadowsky et al. |
| 2017/0348360 | A1 | 12/2017 | Borody |
| 2018/0110810 | A1 | 4/2018 | Sadowsky et al. |
| 2018/0147221 | A1* | 5/2018 | von Maltzahn ......... A61P 35/00 |
| 2018/0153943 | A1 | 6/2018 | Borody |
| 2018/0256652 | A1 | 9/2018 | Borody |
| 2019/0015460 | A1 | 1/2019 | Borody |
| 2019/0015461 | A1 | 1/2019 | Borody |
| 2019/0015462 | A1 | 1/2019 | Borody |
| 2019/0046589 | A1 | 2/2019 | Borody |
| 2019/0134106 | A1 | 5/2019 | Borody |
| 2019/0134144 | A1 | 5/2019 | Adams et al. |
| 2019/0144923 | A1 | 5/2019 | Krajmalnik-Brown et al. |
| 2019/0175665 | A1 | 6/2019 | Borody |
| 2019/0216860 | A1 | 7/2019 | Borody |
| 2019/0247445 | A1 | 8/2019 | Hamilton et al. |
| 2019/0290704 | A1 | 9/2019 | Borody |
| 2019/0328825 | A1 | 10/2019 | Adams et al. |
| 2019/0343897 | A1 | 11/2019 | Borody |
| 2019/0358274 | A1 | 11/2019 | Adams et al. |
| 2020/0181674 | A1* | 6/2020 | Smith ...................... C12Q 1/06 |
| 2020/0188450 | A1* | 6/2020 | Mohty .................... A61P 37/06 |
| 2020/0330526 | A1* | 10/2020 | Kovarik ............. C07K 16/2827 |
| 2021/0283196 | A1* | 9/2021 | Kovarik .................. A61P 31/04 |

FOREIGN PATENT DOCUMENTS

| | | | |
|---|---|---|---|
| CA | 2 391 422 | A1 | 1/2004 |
| CN | 1561387 | A | 1/2005 |
| CN | 101496819 | A | 8/2009 |
| CN | 201441672 | U | 4/2010 |
| CN | 103857402 | A | 6/2014 |
| DE | 2 134 179 | A1 | 1/1973 |
| EP | 0 303 246 | A2 | 2/1989 |
| EP | 0456 418 | B1 | 11/1991 |
| EP | 0 433 299 | B1 | 5/1998 |
| EP | 1 514 572 | A2 | 3/2005 |
| EP | 1 514 572 | A3 | 11/2006 |
| EP | 1 800 688 | A1 | 6/2007 |
| EP | 1 514 572 | B1 | 12/2008 |
| EP | 2 823 822 | B1 | 10/2016 |
| EP | 3424515 | A2 | 1/2019 |
| EP | 3 610 881 | A1 | 2/2020 |
| FR | 1275 | M | 5/1962 |
| FR | 2427 | M | 3/1964 |
| FR | 2828 | M | 10/1964 |
| FR | 5528 | M | 11/1967 |
| FR | 2 244 464 | A1 | 4/1975 |
| GB | 1 271 674 | A | 4/1972 |
| JP | 64-067192 | | 3/1989 |
| JP | H05-306221 | A | 11/1993 |
| JP | H07-242539 | A | 9/1995 |
| JP | H07-242557 | A | 9/1995 |
| JP | 3 144 556 | B2 | 3/2001 |
| JP | 2004-501095 | | 1/2004 |
| JP | 2005-118544 | A | 5/2005 |
| JP | 2008-106066 | | 5/2008 |
| JP | 2010-513359 | | 4/2010 |
| JP | 2010-520234 | A | 6/2010 |
| JP | 2014-507481 | A | 3/2014 |
| JP | 2015-520176 | A | 7/2015 |
| JP | 2016-155880 | A | 9/2016 |
| JP | 2017-514872 | A | 6/2017 |
| KR | 10-0913405 | B1 | 8/2009 |
| WO | WO 90/01335 | A1 | 2/1990 |
| WO | WO 95/33046 | A1 | 12/1995 |
| WO | WO 96/11014 | A1 | 4/1996 |
| WO | WO 98/13068 | A1 | 4/1998 |
| WO | WO 00/07571 | A2 | 2/2000 |
| WO | WO 00/015760 | A1 | 3/2000 |
| WO | WO 00/42168 | * | 7/2000 |
| WO | WO 00/42168 | A2 | 7/2000 |
| WO | WO 02/07741 | A1 | 1/2002 |
| WO | WO 03/033681 | A2 | 4/2003 |
| WO | WO 2005/017095 | A2 | 2/2005 |
| WO | WO 2006/127355 | A2 | 11/2006 |
| WO | WO 2008/077614 | A2 | 7/2008 |
| WO | WO 2008/105715 | A2 | 9/2008 |
| WO | WO 2008/117266 | A2 | 10/2008 |
| WO | WO 2008/117267 | A2 | 10/2008 |
| WO | WO 2008/135090 | A1 | 11/2008 |
| WO | WO 2008/077614 | A3 | 1/2009 |
| WO | WO 2009/024429 | A2 | 2/2009 |
| WO | WO 2009/026306 | A2 | 2/2009 |
| WO | WO 2009/055362 | A1 | 4/2009 |
| WO | WO 2010/036876 | A2 | 4/2010 |
| WO | WO 2010/040020 | A1 | 4/2010 |
| WO | WO 2011/033310 | A1 | 3/2011 |
| WO | WO 2011/094027 | A1 | 8/2011 |
| WO | WO 2011/110347 | A2 | 9/2011 |
| WO | WO 2011/151941 | A1 | 12/2011 |
| WO | WO 2011/152566 | A2 | 12/2011 |
| WO | WO 2012/013861 | A2 | 2/2012 |
| WO | WO 2012/016287 | A2 | 2/2012 |
| WO | WO 2012/016287 | A3 | 2/2012 |
| WO | WO 2012/045150 | A1 | 4/2012 |
| WO | WO 2012/122478 | A1 | 9/2012 |
| WO | WO 2013/037067 | A1 | 3/2013 |
| WO | WO 2013/037068 | | 3/2013 |
| WO | WO 2013/053836 | | 4/2013 |
| WO | WO 2013/090825 | A1 | 6/2013 |
| WO | WO 2013/176774 | A1 | 11/2013 |
| WO | WO 2014/036182 | A2 | 3/2014 |
| WO | WO 2014/070014 | A1 | 5/2014 |
| WO | WO 2014/078911 | A1 | 5/2014 |
| WO | WO 2014/121298 | | 8/2014 |
| WO | WO 2014/152338 | A1 | 9/2014 |
| WO | WO 2014/152484 | A1 | 9/2014 |
| WO | WO 2015/006355 | A2 | 1/2015 |
| WO | WO 2015/051323 | A1 | 4/2015 |
| WO | WO 2015/077794 | A1 | 5/2015 |
| WO | WO 2015/095241 | A2 | 6/2015 |
| WO | WO 2015/124637 | A1 | 8/2015 |
| WO | WO 2015/191922 | A1 | 12/2015 |
| WO | WO 2016/133450 | A1 | 8/2016 |
| WO | WO 2016/183577 | A1 | 11/2016 |
| WO | WO 2016/191356 | A1 | 12/2016 |
| WO | WO 2017/075098 | A1 | 5/2017 |
| WO | WO 2017/091783 | A2 | 6/2017 |
| WO | WO 2017/152137 | A2 | 9/2017 |
| WO | WO 2017/210428 | A1 | 12/2017 |
| WO | WO 2018/006088 | A1 | 1/2018 |
| WO | WO 2018/026913 | A1 | 2/2018 |
| WO | WO 2018/057747 | A1 | 3/2018 |
| WO | WO 2018/187467 | A1 | 10/2018 |

(56) References Cited

FOREIGN PATENT DOCUMENTS

WO WO 2019/032572 A1 2/2019
WO WO 2019/032573 A1 2/2019
WO WO 2019/032575 A1 2/2019
WO WO 2019/075344 A1 4/2019
WO WO 2019/165285 A1 8/2019

OTHER PUBLICATIONS

Heathline (Autoimmune Diseases: Types, Symptoms, Causes and More, https://www.healthline.com/health/autoimmune-disorders, accessed on May 26, 2021) (Year: 2021).*
Deleemans et al., BMC Cancer, 2019; 19:1243 (Year: 2019).*
Bartoletti et al., Enterococcus Bacteremia Care Bundle, Open Forum Infectious Diseases, 2019: 1-9 (Year: 2019).*
Koch et al., Expert Opinion on Biological Therapy, 2004; 4(9): 1519-1531 (Year: 2004).*
Healthline, https://www.healthline.com/health/vre#prevention; accessed on Oct. 29, 2022 (Year: 2022).*
Fenton, et al., "Pseudomembranous colitis associated with antibiotic therapy—an emerging entity," Can Med Assoc J., 111(10):1110-1111 (1974).
Filippo, et al., "Impact of diet in shaping gut microbiota revealed by a comparative study in children from Europe and rural Africa," PNAS, 107(33):14691-14696 (2010).
Finegold, et al., "Gastrointestinal Microflora Studies in Late-Onset Autism," Clinical Infectious Diseases 35:S6 (2002).
Finegold, et al., "Pyrosequencing study of fecal microflora of autistic and control children," Anaerobe 16:444-453 (2010).
Floch, et al., "Probiotics and Dietary Fiber, The Clinical Coming of Age of Intestinal Microecology," J. Clin. Gastroenterology, 27(2):99-100 (1998).
Floch, "Fecal Bacteriotherapy, Fecal Transplant, and the Microbiome," J. Clin. Gastroenterol., 44(8):529-530 (2010).
Flotterod, et al., "Refractory Clostridium difficile infection. Untraditional treatment of antibiotic-induced colitis," Tidsskr Nor Laegeforen, 111:1364-1365 (1991).
Fogarty, et al., Comparison of Bacteroides—Provetella 16S rRNA Genetic Markers for Fecal Samples from Different Animal Species, Applied and Environmental Microbiology, 71(10):5999-6007 (Oct. 2005).
Frank, et al., "Molecular-phylogenetic characterization of microbial community imbalances in human inflammatory bowel diseases," PNAS, 104(34):13780-13785 (2007).
Frantzen, et al., "Empirical evaluation of preservation methods for faecal DNA," Molecular Ecology, 7(10):1423-1428 (1998).
Freeman, et al., "The changing epidemiology of Clostridium difficile infections," Clin Microbiol. Rev., 23(3):529-549 (2010).
Frese, et al., "The evolution of host specialization in the vertebrate gut symbiont *Lactobacillus reuteri,*" PloS Genet., 7(2):e1001314 (2011).
Gaboriau-Routhiau, et al., "The Key Role of Segmented Filamentous Bacteria in the Coordinated Maturation of Gut Helper T Cell Responses," Immunity, 31(4):677-689 (2009).
Garborg, et al., "Results of faecal donor instillation therapy for recurrent Clostridium difficile-associated diarrhoea," Scand J Infect Dis., 42(11-12):857-61 (2010).
Garcia-Pena, et al., "Anaerobic digestion and co-digestion processes of vegetable and fruit residues: Process and microbial ecology," Bioresource Technology 102:9447-9455 (2011).
Garey, et al., "Meta-analysis to assess risk factors for recurrent Clostridium difficile infection," J. Hosp. Infect., 70(4):298-304 (2008).
Geier, et al., "A Comparison of the Autism Treatment Evaluation Checklist (ATEC) and the Childhood Autism Rating Scale (CARS) for the Quantitative Evaluation of Autism," Journal of Mental Health Research in Intellectual Disabilities, 6:255-67 (2013).
Gerding, "Management of Clostridium difficile infection: thinking inside and outside the box," Clin Infect Dis., 51(11):1306-13 (2010).
Geuking, et al., "Intestinal Bacterial Colonization Induces Mutualistic Regulatory T Cell Responses," Immunity, 34:794-806 (2011).
Gill, et al., "Metagenomic Analysis of the Human Distal Gut Microbiome", Science, 312(5778):1355-1359 (2006).
Gitlin, et al., "*Mycobacterium avium* ss *paratuberculosis*-associated Diseases: Piecing the Crohn's Puzzle Together," J Clin Gastroenterol, 46(8):649-655 (2012).
Goehler, et al., "Campylobacter jejuni infection increases anxiety-like behavior in the holeboard: possible anatomical substrates for viscerosensory modulation of exploratory behavior," Brain Behavior Immunology, 22(3):354-366 (2008).
Gondalia, et al., "Faecal microbiota of individuals with autism spectrum disorder," Electronic Journal of Applied Psychology, 6(2):24-29 (2010).
Gough, et al., "Systematic review of intestinal microbiota transplantation (fecal bacteriotherapy) for recurrent Clostridium difficile infection," Clin. Infect. Dis., 53(10):994-1002 (2011).
Gregersen, et al., "Duodenal administered seal oil for patients with subjective food hypersensitivity: an explorative open pilot study," International Journal of General Medicine, 2010(3):383-92.
Grehan, et al., "Durable alteration of the colonic microbiota by the administration of donor fecal flora," Journal of Clinical Gastroenterology, 44(8):551-561 (2010).
Guarner, et al., "Gut flora in health and disease," Lancet, 361(9356):512-519 (2003).
Gustafsson, et al., "Faecal Short-Chain Fatty Acids in Patients with Antibiotic-Associated Diarrhoea, before and after Faecal Enema Treatment," Scand J Gastroenterol, 33:721-727 (1998).
Gustafsson, et al., "The Effect of Faecal Enema on Five Microflora-Associated Characteristics in Patients with Antibiotic-Associated Diarrhoea," Scandinavian Journal of Gastroenterology, 34:580-586 (1999).
Hamilton, et al., "Change in microbial community composition of in patients with recalcitrant Clostridium difficile colitis treated with fecal bacteriotherapy," International Human Microbiome Congress, Poster and Presentation, Vancouver, ON, Canada, Mar. 9-11, 2011.
Hamilton, et al., "High-throughput DNA sequence analysis reveals stable engraftment of gut microbiota following transplantation of gut microbiota following transplantation of previously frozen fecal bacteria," Gut Microbes, 4(2):1-11 (2013).
Hamilton, et al., "Standardized Frozen Preparation for Transplantation of Fecal Microbiota for Recurrent Clostridium difficile Infection," Article and Supplementary Material, Am. J. Gastroenterol., 107(5):761-767 (2012).
Hammock, et al., "2003 Progress Report: Environmental Factors in the Etiology of Autism Analytic Biomarkers (xenobiotic) core," EPA Extramural Report, (2003).
Hanley & McNeil,"The Meaning and Use of the Area under a Receiver Operating Characteristic Curve," Radiology 143:29-36 (1982).
Hayashi, et al., "Phylogenetic Analysis of the Human Gut Microbiota Using 16S rDNA Clone Libraries and Strictly Anaerobic Culture-Based Methods," Microbiol. Immunol., 46(8):535-548 (2002).
Hayashi, et al., "*Prevotella copri* sp. nov. and *Prevotella stercorea* sp. nov., isolated from human faeces," International Journal of Systematic and Evolutionary Microbiology, 57:941-946 (2007).
Hecker, et al., "Fecal Microbiota Transplantation by Freeze-Dried Oral Capsules for Recurrent Clostridium difficile Infection," Open Forum Infect Dis, 3(2): 1-2 (2016).
Hellemans, et al., "Fecal transplantation for recurrent Clostridium difficile colitis, an underused treatment modality," Acta Gastroenterol Belg., 72(2):269-70 (2009).
Henriksson, et al., "Probiotics under the regulatory microscope," Expert Opin. Drug Saf., 4(6):1-9 (2005).
Hensel, et al., "Vagal Ascent and Distribution of 125 I-Tetanus Toxin after Injection into the Anterior Wall of the Stomach," Naunyn-Schmiedeberg's Arch. Pharmacol, 276:395-402 (1973).
Holst, et al., "Biochemistry and cell biology of bacterial endotoxins," FEMS Immunology and Medical Microbiology, 16:83-104 (1996).
Honda, et al., "Regulation of T Cell Responses by Intestinal Commensal Bacteria," Journal of Intestinal Microbiology, vol. 25, 2nd Edition:104 (2011).

(56) References Cited

OTHER PUBLICATIONS

Hongliang, et al., "Freeze-dried, Capsulized Fecal Microbiota Transplantation for Relapsing Clostridium difficile Infection," Journal of Clinical Gastroenterology, 43(6):537-538 (2015).
Hooper, et al., "How host-microbial interactions shape the nutrient environment of the mammalian intestine," Annu. Rev. Nutr., 22:283-307 (2002).
Hope, et al., "Sporadic colorectal cancer-role of the commensal microbiota," FEMS Microbiol. Lett., 244:1-7 (2005).
Horvath, et al., "Gastrointestinal abnormalities in children with autistic disorder," Journal of Pediatrics 135(5):559-563 (1999).
Hota, et al., "Determining Mortality Rates Attributable to Clostridium difficile Infection," Emerg. Infect. Dis., 18(2):305-307 (2012).
Hota, et al., "Oral Vancomycin Followed by Fecal Transplant Versus Tapering Oral Vancomycin," U.S. National Institutes of Health, Clinical Study No. NCT01226992, Oct. 20, 2010, last updated Jan. 14, 2013, Web, May 20, 2014, pp. 1-4 http://clinicaltrials.gov/ct2/show/NCT01226992.
Hsu, et al., "IL-10 Potentiates Differentiation of Human Induced Regulatory T Cells via STAT3 and Foxol," The Journal of Immunology, 3665-3674 (2015).
Hu, et al., "Prospective derivation and validation of a clinical prediction rule for recurrent Clostridium difficile infection," Gastroenterology, 136:1206-1214 (2009).
Huang, et al., "Once-daily propranolol extended-release tablet dosage form: formulation design and in vitro/in vivo investigation," European J. of Pharm. & Biopharm., 58:607-614 (2004).
Huttenhower, et al., "Structure, function and diversity of the healthy human microbiome," The Human Microbiome Project Consortium, Nature, 486:207-214 (2012).
Huws, et al., "As yet uncultured bacteria phylogenetically classified as Prevotella, Lachnospiraceae incertae sedis and unclassified Bacteroidales, Clostridiales and Ruminococcaceae may play a predominant role in ruminal biohydrogenationemion", Environmental Microbiology, 13(6):1500-1512 (2011).
Immunology in the 21st Century: Defeating Infection, Autoimmunity, Allergy, and Cancer, ICI 2010 Wrap-up Report, 14th International Congress of Immunology, pp. 1 (2010).
Inflammatory Bowel Disease Facts, Disease Prevention and Treatment Strategies, Crohn's Disease and Inflammatory Bowel Disease (IBD), HealingWithNutrition.com, pp. 1-4, n.d., Web, Oct. 23, 2005 http://www.HealingWithNutrition.com/disease/inflambowels/chrohns.html.
Information Disclosure Statement filed Nov. 28, 2017, in U.S. Appl. No. 15/487,553.
International Preliminary Examination Report completed Nov. 19, 2002, in International Application No. PCT/AU2001/000907, 19 pgs.
International Preliminary Report on Patentability completed Dec. 12, 2012, in International No. PCT/AU2011/000987, 35 pgs.
Poster 064-03 presented at the 14th International Congress of Immunology, Aug. 22-27, 2010, in Kyoto (Atarashi et al., Regulation of colonic regulatory T cells by *Clostridium* species).
Prakash, et al., "Colon-targeted delivery of live bacterial cell biotherapeutics including microencapsulated live bacterial cells," Biologics: Targets & Theragy, 2(3):355-378 (2008).
Prevention of Sudden Infant Death Syndrome, Healthtouch.com, Thomson MICROMEDEX, pp. 1-4, n.d., Web, Nov. 23, 2005.
Qin, et al., "A human gut microbial gene catalogue established by metagenomic sequencing," Nature 464:59-67 (2010).
Qiu, et al., "Faecalibacterium prausnitzii upregulates regulatory T cells and anti-inflammatory cytokines in treating TNBS-induced colitis," Journal of Crohn's and Colitis, 7:e558-e568 (2013).
Rabeneck, et al., "Bleeding and perforation after outpatient colonoscopy and their risk factors in usual clinical practice," Gastroenterology, 135(6):1899-1906 (2008).
Rager, et al., "Evaluation of rumen transfaunation after surgical correction of left-sided displacement of the abomasum in cows," J. Am. Vet. Med. Assoc., 225(6):915-920 (2004).
Ramesh, et al., "Prevention of Clostridium difficile-induced ileocecitis with Bacteriophage," Anaerobe, 5:69-78 (1999).
Rao, et al., "Evaluation of gastrointestinal transit in clinical practice: position paper of the American and European Neurogastroenterology and Motility Societies," Neurogastroenterol. Motil., 23(1):8-23 (2011).
Rautava, "Potential uses of probiotics in the neonate," Seminars in Fetal & Neonatal Medicine, 12:45-53 (2007).
Rea, et al., "Gut solutions to a gut problem: bacteriocins, probiotics and bacteriophage for control of Clostridium difficile infection," Journal of Medical Microbiology, 62:1369-1378 (2013).
Redelings, et al., "Increase in Clostridium difficile-related mortality rates, United States, 1999-2004," Emerg Infect Dis., 13(9):1417-1419 (2007).
Rex, et al., "American College of Gastroenterology guidelines for colorectal cancer screening 2008," Am. J. Gastroenterol., 104(3):739-750 (2009).
Ricciardi, et al., "Increasing prevalence and severity of Clostridium difficile colitis in hospitalized patients in the United States," Arch Surg., 142(7):624-631 (2007).
Roberts, Generation and Development Microbial Drug Products, CSO Vedanta Biosciences, 1st Microbiome Drug Development Summit, pp. 1-17 (2016).
Robertson, et al., "Intestinal Permeability and Glucagon-like peptide-2 in Children with Autism: A Controlled Pilot Study", Journal of Autism Development Disorder, 38:10661071 (2008).
Robinson, et al., "Characterization of the Cecal Bacteria of Normal Pigs", Applied and Environmental Microbiology, 41(4):950-955 (1981).
Rodemann, et al., "Incidence of Clostridium difficile infection in inflammatory bowel disease," Clin Gastroenterol Hepatol., 5(3):339-344 (2007).
Rohlke, et al., "Fecal flora reconstitution for recurrent Clostridium difficile infection: results and methodology," J Clin Gastroenterol., 44(8):567-570 (2010).
Roid, et al., Leiter International Performance Scale—Revised, Stoelting (1997).
Rolfe, et al., "Bacterial interference between Clostridium difficile and normal fecal flora," J Infect Dis., 143(3):470-475 (1981).
Rossen, et al., "Findings From a Randomized Controlled Trial of Fecal Transplantation for Patients with Ulcerative Colitis," Gastroenterology, 149(1):110-8 (2015).
Round, et al., "Inducible Foxp3+ regulatory T-cell development by a commensal bacterium of the intestinal microbiota," PNAS, 107(27):12204-12209 (2010).
Round, et al., "The Toll-like receptor pathway establishes commensal gut colonization," Science, 332(6032):974-977 (2011).
Round, et al., "The gut microbiota shapes intestinal immune responses during health and disease," Nat. Rev. Immunol., 9(5):313-323 (2009).
Rupnik, et al., "Clostridium difficile infection: new developments in epidemiology and pathogenesis," Nat. Rev. Microbiol., 7(7):526-536 (2009).
Russell, et al., "Fecal bacteriotherapy for relapsing Clostridium difficile infection in a child: a proposed treatment protocol," Pediatrics, 126(1):e239-42 (2010).
Salazar, et al, "Exopolysaccharides Produced by Intestinal Bifidobacterium Strains Act as Fermentable Substrates for Intestinal Bacteria", Applied and Environmental Microbiology, 74(15):4737-4745 (2008).
Sambol, et al., "Colonization for the prevention of Clostridium difficile disease in hamsters," J. Infect. Dis., 186(12):1781-1789 (2002).
Sanchez, et al., "The Role of Natural Regulatory T cells in Infection," Immunol Res., 49(0):124-134 (2011).
Sandler, et al., "Possible Gut-Brain Interaction Contributing to Delayed Onset Autism Symptomatology," Fourth Int. Symp. Brain-Gut Interactions, Blackwell Science Ltd., 10(4):33 (1998).
Sandler, et al., "Short-Term Benefit From Oral Vancomycin Treatment of Regressive-Onset Autism," Journal of Child Neurology, 15(7):429-435 (2000).
Sartor, "Therapeutic correction of bacterial dysbiosis discovered by molecular techniques," PNAS, 105(43):16413-16414 (2008).

(56) References Cited

OTHER PUBLICATIONS

Schauer & Falkow, "Attaching and Effacing Locus of a Citrobacter freundii BiotypeThat Cuases Transmissible Murine Colonic Hyperplasia," Infection and Immunity, 61(6):2486-2492 (1993).
Schiller, "Review article," the therapy of constipation, Ailment Pharmacol. Ther. 15:749-763 (2001).
Schloss, et al., "Introducing mothur: Open-Source, Platform-Independent, Community-Supported Software for Describing and Comparing Microbial Communities," Applied and Environmental Microbiology, 75(23):7537-7541 (2009).
Schneider, et al., "Oral Human Immunoglobulin for Children with Autism and Gastrointestinal Dysfunction: A Prospective, Open-Label Study," Journal of Autism Development Disorder, 36:1053-1064 (2006).
Schopler, et al., "Childhood autism rating scale-second edition (CARS2)," Western Psychological Services, 4-5, 93 (2010).
Schwan, et al., "Relapsing Clostridium Difficile Enterocolitis Cured by Rectal Infusion of Homologous Faeces," The Lancet, 322(8354):845 (1983).
Schwan, et al., "Relapsing Clostridium difficile Enterocolitis Cured by Rectal Infusion of Normal Faeces," Scand. J. Infect. Dis., 16(2):211-215 (1984).
Seeff, et al., "How many endoscopies are performed for colorectal cancer screening? Results from CDC's survey of endoscopic capacity," Gastroenterology, 127:1670-1677 (2004).
Sekirov, et al., "Gut microbiota in health and disease," Physiol. Rev., 90(3):859-904 (2010).
Sell, et al., "Bacteriophage and Bacteriocin Typing Scheme for Clostridium difficile,"Journal of Clinical Microbiology, 17(6):1148-1152 (1983).
Setlow, "I Will Survive: Protecting and Repairing Spore DNA," Journal of Bacteriology, 174(9):2737-2741 (1992).
Setlow, "The bacterial spore: nature's survival package," Culture, 26(2):1-4 (2005).
Sghir, et al., "Quantification of Bacterial Groups within Human Fecal Flora by Oligonucleotide Prode Hybridization," Applied and Environmental Microbiology, 66(5):2263-2266 (2000).
Shi, et al., "Fecal Microbiota Transplantation for Ulcerative Colitis: A Systematic Review and Meta-Analysis," PLOS One, 1-18 (2016).
Shim, et al., "Primary symptomless colonisation by Clostridium difficile and decreased risk of subsequent diarrhea," The Lancet, 351(9103):633-666 (1998).
Silverman, et al., "Success of self-administered home fecal transplantation for chronic Clostridium difficile infection," Clin. Gastroenterol. Hepatol., 8(5):471-473 (2010).
Simor, et al., "Clostridium difficile in long-term-care facilities for the elderly," Infect Control Hosp Epidemiol., 23(11):696-703 (2002).
Singh, et al., "Do NSAIDs, antibiotics, infections, or stress trigger flares in IBD?" Am J Gastroenterol., 104(5):1298-1313 (2009).
Sleator, "The human superorganism—of microbes and men," Med. Hypotheses, 74(2):214-215 (2010).
Smits, et al., "Therapeutic potential of fecal microbiota transplantation," Gastroenterology, 145:946-953 (2013).
Sokol, et al., Faecalibacterium prausnitzii is an anti-inflammatory commensal bacterium identified by gut microbiota analysis of Crohn disease patients, Proceedings of the National Academy of Sciences, 105(43):16731-16736 (2008).
Sokol, et al., "Low Counts of Faecalibacterium prausnitzii in Colitis Microbiota," Inflamm. Bowel Dis., pp. 1-7 (2009).
Song, et al, "Real-Time PCR Quant tation of Clostridia in Feces of Autistic Children" Applied and Environmental Microbiology, 70(11):6459-6465 (2004).
Sparrow, et al., "Vineland Adaptive Behavior Scales," 2nd Edition American Guidance Service, 3 (2005).
Stocks, "Mechanism and Use of the Commercially Available Viability Stain, BacLight," Cytometry Part A, 61(A):189-195 (2004).
Martin-Dejardin, et al., "A way to follow the viability of encapsulated Bifidobacterium bifidum subjected to a freeze-drying process in order to target the colon: Interest of flow cytometry," European Journal of Pharmaceutical Sciences, 49:166-74 (2013).
Maslowski, et al., "Diet, gut microbiota and immune responses," Nat Immunol., 12(1):5-9 (2011).
McDonald, et al., "An Epidemic, Toxin Gene-Variant Strain of Clostridium difficile," N Engl J Med., 353(23):2433-41 (2005).
McDonald, et al., "Clostridium difficile Infection in Patients Discharged from US Short-stay Hospitals, 1996-2003" Emerg. Infect. Dis, 12(3):409-415 (2006).
McFarland, et al., "Breaking the Cycle: Treatment Strategies for 163 Cases of Recurrent Clostridium difficile Disease," Am. J. Gastroenterol., 97(7):1769-1775 (2002).
McFarland, et al., "Implications of the changing face of Clostridium difficile disease for health care practitioners," Am J Infect Control., 35(4):237-253 (2007).
McFarland, et al., "Meta-Analysis of Probiotics for the Prevention of Antibiotic Associated Diarrhea and the Treatment of Clostridium difficile Disease," Am J Gastroenterol., 101(4):812-22 (2006).
McFarland, et al., "Nosocomial Acquisition of Clostridium Difficile Infection," N Engl J Med., 320(4):204-210 (1989).
McFarland, et al., "Recurrent Clostridium Difficile Disease: Epidemiology and Clinical Characteristics," Infect Control Hosp Epidemiol., 20(1):43-50 (1999).
McFarland, et al., "Renewed interest in a difficult disease: Clostridium difficile infections—epidemiology and current treatment strategies," Curr Opin Gastroenterol., 25(1):24-35 (2008).
Meadows, "Gut Bacteria May Override Genetic Protections against Diabetes," PLOS Biology, 9(12):e1001215 (2011).
Miller, et al., "Health care-associated Clostridium difficile infection in Canada: patient age and infecting strain type are highly predictive of severe outcome and mortality," Clin Infect Dis., 50(2):194-201 (2010).
Miller, et al., "Long-term follow-up of patients with fulminant Clostridium difficile colitis," J. Gastrointest. Surg., 13(5):956-959 (2009).
Miller, et al., "Morbidity, mortality, and healthcare burden of nosocomial Clostridium difficile-associated diarrhea in Canadian hospitals," Infect Control Hosp Epidemiol., 23(3):137-40 (2002).
Miller, "The fascination with probiotics for Clostridium difficile infection: lack of evidence for prophylactic or therapeutic efficacy," Anaerobe, 15(6):281-284 (2009).
Minami, et al., "Effects of lipopolysaccharides and chelator onmercury content in the cerebrum of thimerosal administered mice," Environmental Toxicology and Pharmacology, 24:316-320 (2007).
Minami, et al., "Roles of nitric oxide prostaglandins in the increased permeability of the blood-brain barrier caused by lipopolysaccharide," Environmental Toxicology and Pharmacology, 5:35-41 (1998).
Moayyedi, et al., "Fecal Microbiota Transplantation Induces Remission in Patients With Active Ulcerative Colitis in a Randomized Controlled Trial," Gastroenterology, 149(1):102-9 (2015).
Molecular Studies in Autism, 2004 Funding Cycle, Cure Autism Now, Cure Autism Now Foundation, pp. 1-7 (2005) www.cureautismnow.org.
Molloy & Manning-Courtney, "Prevalence of chronic gastrointestinal symptoms in children with autism and autistic spectrum disorders," Autism 7(2):165-171 (2003).
Momose, et al., "16S rRNA gene sequence-based analysis of clostridia related to conversion of germfree mice to the normal state," Journal of Applied Microbiology, 107:2088-2097 (2009).
Morris, et al., "Clostridium difficile Colitis: An Increasingly Aggressive Iatrogenic Disease?" Arch Surg., 137(10):1096-1100 (2002).
Mucosal immunity: homeostasis (WS-064): Chairpersons: Toshiaki Ohteki, Makoto Iwata, International Immunology, 22:Suppl 1 Pt. 3, 1-9 (2010).
Mullard, "Microbiology: The Inside Story," Nature, 453:578-580 (2008).
Mulloy, et al., "Gluten-free and casein-free diets in the treatment of autism spectrum disorders: A systematic review," Research in Autism Spectrum Disorders, 4:328-339 (2010).
Murai, et al., "Interleukin 10 acts on regulatory T cells to maintain expression of the transcription factor Foxp3 and suppressive function in mice with colitis," Nat Immunol., pp. 1-20 (2009).
Mutaflor, "Brief Summary of Therapeutic Principles," Ardeypharm GmbH 0796 D-58313 Herdecke Germany, 6 pgs (2006).

(56) References Cited

OTHER PUBLICATIONS

Mutaflor, "For Functional and Inflammatory Bowel Diseases for Extraintestinal Manifestations for Activation of the Body's In-Built Defences," Ardeypharm GmbH 0796, D-58313 Herdecke Germany, 8 pgs (2006).
Mutaflor, "Safety of Therapy," Ardeypharm GmbH 0796, D-58313 Herdecke Germany, 4 pgs (1988).
Muto, et al., "A Large Outbreak of Clostridium difficile-Associated Disease with an Unexpected Proportion of Deaths and Colectomies at a Teaching Hospital Following Increased Fluoroquinolone Use," Infect Control Hosp Epidemiol., 26(3):273-80 (2005).
Niehus & Lord, "Early Medical History of Children with Autism Spectrum Disorders," Journal of Developmental Behavioral Pediatrics, 27(2):S120-S127 (2006).
Nieuwdorp, et al., ["Treatment of recurrent Clostridium difficile-associated diarrhoea with a suspension of donor faeces"], Ned Tijdschr Geneeskd, 152(35):1927-32 (2008).
Niu, et al., "Prevalence and Impact of Bacteriophages on the Presence of *Escherichia coli* O157:H7 in Feedlot Cattle and Their Environment," Applied and Environmental Microbiology, 75(5): 1271-8 (2009).
O'Hara, et al., "The gut flora as a forgotten organ," EMBO Rep., 7(7):688-693 (2006).
O'Brien, et al., "The emerging infectious challenge of clostridium difficile-associated disease in Massachusetts hospitals: clinical and economic consequences," Infect Control Hosp Epidemiol., 28(11):1219-27 (2007).
Ochoa-Reparaz, et al., "Gut, Bugs, and Brain: Role of Commensal Bacteria in the Control of Central Nervous System Disease", Annals Neurology, 69:240-247 (2011).
O'Connor, et al., "Clostridium difficile Infection Caused by the Epidemic BI/NAP1/027 Strain," Gastroenterology, 136(6):1913-1924 (2009).
Office Action dated Sep. 18, 2015, in European Patent Application No. 11 728 077.6.
O'Garra, et al., "IL-10—producing and naturally occuring CD4+ Tregs: limiting collateral damage," The Journal of Clinical Investigation, 114:1372-1378 (2004).
O'Hara, et al., "Functional modulation of human intestinal epithelial cell responses by Bifidobacterium infantis and Lactobacillus salivarius," Immunology 118:202-215 (2006).
Okada, et al., "Effects of Fecal Microorganisms and Their Chloroform-Resistant Variants Derived from Mice, Rats, and Humans on Immunological and Physiological Characteristics of the Intestines of Ex-germfree Mice," Infection and Immunity, 62(12):5442-5446 (1994).
Olson, et al., "The Gut Microbiota Mediates the Anti-Seizure Effects of the Ketogenic Diet," Cell, 173:1728-1741 (2018) https://linkinghub.elsevier.com/retrieve/pii/S0092867418305208.
Ott, et al., "Efficacy of Sterile Fecal Filtrate Transfer for Treating Patients With Clostridium difficile Infection," Gastroenterology, 152(4):799-811 (2017).
Paramsothy, et al., "Multidonor intensive faecal microbiota transplantation for active ulcerative colitis: a randomised placebo-controlled trial," The Lancet, published online, 11 pages (2017).
Paramsothy, et al., "Gastroenterologist perceptions of faecal microbiota transplantation," World J Gastroenterol, 21(38): 10907-10914 (2015).
Parracho, et al., "Differences between the gut microflora of children with autistic spectrum disorders and that of healthy children," Journal of Medicine Microbiology, 54:987-991 (2005).
Paterson, et al., "Putting back the bugs: Bacterial treatment relieves chronic diarrhoea," Med J Aus, 160:232-233 (1994).
Patterson, et al., "Special organism isolation: attempting to bridge the gap," Infect Control Hosp Epidemiol., 15(5):335-338 (1994).
Pearce, et al., "Modification of the colonic microflora using probiotics: The way forward?," Gut, 41(Suppl 3):A63 (1997).
Pearce, et al., "The use of probiotic therapy as a novel approach to the management of irritable bowel syndrome: a preliminary study," J Gastroenterol & Hepatol, 12(Suppl):A129 (1997).
Pépin, et al., "Clostridium difficile-associated diarrhea in a region of Quebec from 1991 to 2003: a changing pattern of disease severity," CMAJ, 171(5):466-472 (2004).
Pépin, et al., "Emergence of Fluoroquinolones as the Predominant Risk Factor for Clostridium difficile-Associated Diarrhea: A Cohort Study During an Epidemic in Quebec," Clin Infect Dis., 41(9):1254-1260 (2005).
Pépin, et al., "Management and Outcomes of a First Recurrence of Clostridium difficile-Associated Disease in Quebec, Canada," Clin. Infect. Dis., 42:758-764 (2006).
Persky, et al., "Treatment of recurrent Clostridium difficile-associated diarrhea by administration of donated stool directly through a colonoscope," Am J Gastroenterol., 95(11):3283-3285 (2000).
Petrof, et al., "Stool substitute transplant therapy for the eradication of Clostridium difficile infection: 'RePOOPulating' the gut," Microbiome, 1:3 (2013).
Petrof, "Harnessing the healthy gut microbiota to cure patients with recurrent C. difficile infection," U.S. National Institutes of Health, Clinical Study No. NCT01372943, pp. 1-2, last updated Nov. 6, 2013, Web, May 22, 2014 http://clinicaltrials.gov/ct2/show/NCT01372943.
Pillai, et al., "Probiotics for treatment of Clostridium difficile-associated colitis in adults (Review)," Cochrane Database Syst Rev., (1):CD004611 (2008).
Porter, "Coating of pharmaceutical dosage forms," In D.B. Troy (Ed.), Remington: The Science and Practice of Pharmacy, Chapter 46, pp. 929-938 (2005).
Sullivan, et al., "Effect of supplement with lactic-acid producing bacteria on fatigue and physical activity in patients with chronic fatigue syndrome," Nutritional Journal, 8(4):1-6 (2009).
Sun, et al., "Tag-Encoded FLX Amplicon Pyrosequencing for the Elucidation of Microbial and Functional Gene Diversity in Any Environment", Methods and Applications, Methods in Molecular Biology, 733:129-141 (2011).
Sunil, et al., "Design and evaluation of lornoxicam bilayered tablets for biphasic release," Brazilian Journal of Pharmaceutical Sciences, 48(4):609-19 (2012).
Surawicz, et al., "Treatment of refractory and recurrent Clostridium difficile infection," Nat. Rev. Gastroenterol. Hepatol., 8(6):330-339 (2011).
Surawicz, "Reining in Recurrent Clostridium difficile Infection—Who's at Risk?," Gastroenterology, 136:1152-1154 (2009).
Sutherland, et al., "Lyophilized Clostridium perfringens 3 alpha-and Clostridium bifermentans 7 alpha-hydroxysteroid dehydrogenases: two new stable enzyme preparations for routine bile acid analysis," Biochim Biophys Acta, 962(1):116-121 (1988).
Takaishi, et al., "Imbalance in intestinal microflora constitution could be involved in the pathogenesis of inflammatory bowel disease," J. Med. Microbiol., 298:463-472 (2008).
Takeda, et al., "Serum Haloperidol Levels of Schizophrenics Receiving Treatment for Tuberculosis," Clinical Neuropharmacology, 9(4):386-397 (1986).
Tannock, et al., "A new macrocyclic antibiotic, fidaxomicin (OPT-80), causes less alteration to the bowel microbiota of Clostridium difficile-infected patients than does vancomycin," Microbiology, 156(11):3354-3359 (2010).
Tanque, et al., "Immune response to gut microbiota-commensals and pathogens," Gut Microbes, 1(4):224-233 (2010).
Tap, et al., "Towards the human intestinal microbiota phylogenetic core," Environmental Microbiology, 11(10):2574-2584 (2009).
Taras, et al., "Reclassification of Eubacterium formicigenerans Holdeman and Moore 1974 as *Dorea formicigenerans* gen. nov., comb. nov., and description of *Dorea longicatena* sp. nov., isolated from human faeces," International Journal of Systematic and Evolutionary Microbiology, 52:423-428 (2002).
Teasley, et al., "Prospective randomised trial of metronidazole versus vancomycin for Clostridium-difficile-associated diarrhoea and colitis," The Lancet, 2(8358):1043-1046 (1983).
Tian, et al., "Freeze-dried, Capsulized Fecal Microbiota Transplanation for Relapsing Clostridium difficile Infection," Journal of Clinical Gastroenterology, 49(6):537-538 (2015).

(56) References Cited

OTHER PUBLICATIONS

Tilg, et al., "Gut microbiome, obesity, and metabolic dysfunction," J. Clin. Invest., 121(6):2126-2132 (2011).
Tremaroli, et al., "Function interactions between the gut microbiota and host metabolism," Nature, 489:242-249 (2012).
Trent, et al., "Diversity of endotoxin and its impact on pathogenesis," Journal Endotoxin Research, 12(4):205-223 (2006).
Turnbaugh, et al., "A core gut microbiorne in obese and lean twins," Nature, 457(7228):480-484 (2009).
Tvede, et al., "Bacteriotherapy for chronic relapsing Clostridium difficile diarrhea in six patients," The Lancet, 1:1156-1160 (1989).
Udall, et al., "Development of Gastrointestinal Mucosal Barrier. I. The Effect of Age on Intestinal Permeability to Macromolecules," Journal of Pediatric Research, 15:241-244 (1981).
Van Andel, et al., "Interleukin-12 Has a Role in Mediating Resistance of Murine Strains to Tyzzer's Disease," Infect. Immun., 66(10):4942-4946 (1998).
Van Der Waaij, et al., "Direct Flow Cytometry of Anaerobic Bacteria in Human Feces," Cytometry, 16:270-279 (1994).
Van Immerseel, et al., "Butyric acid-producing anaerobic bacteria as a novel probiotic treatment approach for inflammatory bowel disease," Journal of Medical Microbiology, 59:141-143 (2010).
Van Nood, et al., "Struggling with Recurrent Clostridium difficile Infections: Is Donor Faeces the Solution?," Euro Surveill., 14(34):1-6 (2009).
Van Nood, "Duodenal infusion of donor feces for recurrent Clostridium difficile," New England Journal of Medicine, 368(5):407-415 (2013).
Van Passel, et al., "The Genome of Akkermansia muciniphila, a Dedicated Intestinal Mucin Degrader, and Its Use in Exploring Intestinal Metagenomesvan," Plos One 6(3):e16876 (2011).
Vaughn, et al., "Novel treatment options for ulcerative colitis," Future Science, 1-20 (2013).
Veldhuyzen Van Zanten, et al., "Drug Treatment of Functional Dyspepsia: A Systematic Analysis of Trial Methodology with Recommendations for Design of Future Trials," Am. J. Gastroenterol., 91(4):660-673 (1996).
Veldhuyzen Van Zanten, et al., "Validation of a 7-point Global Overall Symptom scale to measure the severity of dyspepsia symptoms in clinical trials," Ailment Pharmacol. Ther., 23(4):521-529 (2006).
Venugopal, et al., "Fidaxomicin: A Novel Macrocyclic Antibiotic Approved for Treatment of Clostridium difficile Infection," Clin Infect Dis, 54(4):568-74 (2012).
Vidhyalakshmi, et al.,"Encapsulation "The Future of Probiotics"—A Review," Advances in Biological Research, 3(3-4):96-103 (2009).
Vrieze, et al., "The environment within: how gut microbiota may influence metabolism and body composition," Diabetologia, 53(4):606-613 (2010).
Vulevic, et al., "Modulation of the fecal microflora profile and immune function by a novel trans-galactooligosaccharide mixture (B-GOS) in healthy elderly volunteers," Am J Clin Nutr, 88:1438-46 (2008).
Wachsmann, et al., "Characterization of an Orotic Acid Fermenting Bacterium, *Zymobacterium oroticum,* nov. gen., nov. spec.," Journal of Bacteriology, 68(4):400-404 (1954).
Walter, et al., "Host-microbial symbiosis in the vertebrate gastrointestinal tract and the Lactobacillus reuteri paradigm," PNAS USA, 108(Suppl 1):4645-4652 (2011).
Wang, et al., "Low Relative Abundances of the Mucolytic Bacterium Akkermansia muciniphila and *Bifidobacterium* spp. in Feces of Children with Autism," Applied and Environmental Microbiology, 77(18):6718-6721 (2011).
Warnock & Peck, "A roadmap for biomarker qualification," Nature Biotechnology, 28(5):444-445 (2010).
Warny, et al., "Toxin production by an emerging strain of Clostridium difficile associated with outbreaks of severe disease in North America and Europe," Lancet, 366(9491):1079-84 (2005).
Warren, et al., "*Clostridium aldenense* sp. nov. and *Clostridium citroniae* sp. nov. Isolated from Human Clinical Infections," Journal of Clinical Microbiology, 44(7):2416-2422 (2006).
Wasfy, et al., "Comparison of Preservation Media for Storage of Stool Samples," Journal of Clinical Microbiology, 33(8):2176-2178 (1995).
Weingarden, et al., "Dynamic changes in short- and long-term bacterial composition following fecal microbiota transplantation for recurrent Clostridium difficile infection," Microbiome, 3(10), 8 pages (2015).
Weissman, et al., "Stool Transplants: Ready for Prime Time?" Current Gastroenterology Reports, 14:313-316 (2012).
Wells, et al., "Clostridia: Sporeforming Anaerobic Bacilli," Medical Microbiology—NCBI Bookshelf, 4th Edition, Chapter 18, pp. 1-20 (1996) https://www.ncbi.nlm.nih.gov/books/NBK8219/?report=printable.
Wenisch, et al., "Comparison of Vancomycin, Teicoplanin, Metronidazole, and Fusidic Acid for the Treatment of Clostridium difficile-Associated Diarrhea," Clin Infect Dis., 22(5):813-818 (1996).
Wettstein, et al., "Fecal Bacteriotherapy—An effective Treatment for Relapsing Symptomatic Clostridium difficile Infection," Abstract, 15th United European Gastroenterology Week (UEGW) Poster presentations, United European Gastroenterology Federation, France, A303 (2007).
Wettstein, et al., "Skewered diverticulum: another cause of abdominal pain," Internal Med J, 31(8):495-496 (2001).
Wikoff, et al., "Metabolomics analysis reveals large effects of gut microflora on mammalian blood metabolites," PNAS, 106(10):3698-3703 (2009).
Williams, et al., "Impaired Carbohydrate Digestion and Transport and Mucosal Dysbiosis in the Intestines of Children with Autism and Gastrointestinal Disturbances," PLoS ONE, 6(9):e24585 (Sep. 2011).
Willing, et al., "Shifting the balance: antibiotic effects on host-microbiota mutualism," Nature Reviews—Microbiology, 9:233-243 (2011).
Wilson, et al., "Human Colonic Biota Studied by Ribosomal DNA Sequence Analysis," Appl. Environ. Microbiol., 2(7):2273-2278 (1996).
Wolcott, et al., "Evaluation of the bacterial diversity among and within individual venous leg ulcers using bacterial tag-encoded FLX and Titanium amplicon pyrosequencing and metagenomic approaches," BMC Microbiology, 9:226 (2009).
Wu, et al., "Focused Evolution of HIV-1 Neutralizing Antibodies Revealed by Structures and Deep Sequencing," Science, 333:1593-1602 (2011).
Yoon, et al., "Treatment of Refractory/Recurrent C. difficile-associated Disease by Donated Stool Transplanted Via Colonoscopy: A Case Series of 12 patients," J Clin Gastroenterol., 44(8):562-566 (2010).
You, et al., "Successful treatment of fulminant Clostridium difficile infection with fecal bacteriotherapy," Ann. Intern. Med., 148(8):632-633 (2008).
Youngster, et al., "Oral, Capsulized, Frozen Microbiota Transplantation for Relapsing Clostridium difficile Infection," American Medical Association, 312 (174) 1772-1778 (2014).
Yue, et al., "Similarity Measure Based on Species Proportions," Commun. Stat. Theor. Methods, 34(11):2123-2131 (2005).
Zar, et al., "A Comparison of Vancomycin and Metronidazole for the Treatment of Clostridium difficile-Associated Diarrhea, Stratified by Disease Severity," Clin Infect Dis., 45(3):302-307 (2007).
Zhang, et al, "Influence of Microbiota on Intestinal Immune System in Ulcerative Colitis and Its Intervention," Frontiers in Immunology, 8(Article 1674):1-11 (2017).
Buie, et al., "Evaluation, Diagnosis, and Treatment of Gastrointestinal Disorders in Individuals With ASDs: A Consensus Report," Pediatrics, 125:S1-S18 (2010).
Cammarota, et al., "Randomised clinical trial: faecal microbiota transplantation by colonoscopy vs. vancomycin for the treatment of recurrent Clostridium difficile infection," Alimentary Pharmacology & Therapeutics, 41(9):835-843 (2015).

(56) References Cited

OTHER PUBLICATIONS

Cammarota, et al., "Review article: biofile formation by Helicobacter pylori as a target for eradication of resistant infection," Aliment Pharmacol Ther, 36:222-30 (2012).
Campbell, et al., "The many faces of Crohn's Disease: Latest concepts in etiology," OJIM, 2(2):107-115 (2012).
Cangelosi, et al., "Dead or Alive: Molecular Assessment of Microbial Viability," Appl. Environ. Microbiol., 80(19):5884-5891 (2014).
Cano, et al., "Revival and identification of bacterial spores in 25-40 million year old Dominican Amber Science," Science, 268(5213):1060-1064 (1995).
Cato, et al., "Clostridium oroticum comb. nov. amended description," International Journal of Systematic Bacteriology, 17(1):9-13 (1968).
Celik, et al., "Factors influencing the stability of freeze-dried stress-resilient and stress-sensitive strains of bifidobacteria," J. Dairy Sci., 96(6):3506-16 (2013).
Center for Disease Control, "Severe Clostridium difficile-associated disease in populations previously at low risk—four states, 2005." Morbidity and Mortality Weekly Report, 54(47):1201-1205 (2005).
Chamberlain, et al., "MAP-associated Crohn's Disease, MAP, Koch's postulates, causality and Crohn's Disease," Digestive and Liver Disease, 39:790-794 (2007).
Chamberlain, et al., "Primary treatment of Crohn's disease: combined antibiotics taking center stage," Expert Rev. Clin. Immunol., 7(6):751-760 (2011).
Chang, et al., "Decreased diversity of the fecal Microbiome in recurrent Clostridium difficile-associated diarrhea," J. Infect. Dis., 197(3):435-438 (2008).
Chao, et al., "Estimating the Number via Sample Coverage," Journal of the American Statistical Association, 87(417):210-217 (1992).
Chen, et al., "A mouse model of Clostridium difficile-associated disease," Gastroenterology, 135(6):1984-1992 (2008).
Cherif, et al., "Thuricin 7: a novel bacteriocin produced by Bacillus thuringiensis BMG1.7, a new strain isolated from soil," Letters in Applied Microbiology, 32:243-7 (2001).
Chibani-Chennoufi, et al., "In Vitro and In Vivo Bacteriolytic Activities of *Escherichia coli* Phages: Implications for Phage Therapy," Antimicrobial Agents and Chemotherapy, 48(7):2558-2569 (2004).
Choi, et al., "Fecal Microbiota Transplantation: Current Applications, Effectiveness, and Future Perspectives," Clin. Endosc., 49:257-265 (2016).
Chopra, et al., "Recent epidemiology of Clostridium difficile infection during hematopoietic stem cell transplantation," Clin Transplant., 25(1):E82-E87 (2011).
Chu, et al., "Profiling Living Bacteria Informs Preparation of Fecal Microbiota Transplantations," PLOS One, 1-16 (2017).
Citron, et al., "In Vitro Activities of CB-183,315, Vancomycin, and Metronidazole against 556 Strains of Clostridium difficile, 445 Other Intestinal Anaerobes, and 56 Enterobacteriaceae Species," Antimicrob Agents Chemother., 56(3):1613-1615 (2012).
Claesson, et al., "Comparison of two next-generation sequencing technologies for resolving highly complex microbiota composition using tandem variable 16S rRNA gene regions," Nucleic Acids Research, 38(22):1-13 (2010).
Clancy, et al., "Anti-MAP Therapy Induces and Maintains Remission in Severe Crohn's Disease," Ann NY Acad Sci, p. 1 (2005).
Claus, et al., "Colonization-induced host-gut microbial metabolic interaction," MBio, 2(2):e00271-00210 (2011).
Claus, et al., "Systemic multicompartmental effects of the gut microbiome on mouse metabolic phenotypes," Mol. Syst. Biol., 4(1):219 (2008).
Cohen, et al., "The PDD Behavior Inventory: A Rating Scale for Assessing Response to Intervention in Children with Pervasive Development Disorder," J. Autism Dev. Disord., 33(1):31-45 (2003).
Cohen, et al., "Clinical practice guidelines for Clostridium difficile infection in adults: 2010 update by the society for healthcare epidemiology of America (SHEA) and the infectious diseases society of America (IDSA)," Infect Control Hosp Epidemiol., 31(5):431-55 (2010).
Cole, et al., "Psychological Risk Factors for HIV Pathogenesis: Mediation by the Autonomic Nervous System," Society of Biological Psychiatry, 54:1444-1456 (2003).
Cole, et al., "The Ribosomal Database Project (RDP-II): previewing a new autoaligner that allows regular updates and the new prokaryotic taxonomy," Nucleic Acids Research 31(1): 442-443 (2003).
Cole, J.R., et al., "The Ribosomal Database Project: improved alignments and new tools for rRNA analysis," Nucleic Acids Research, 37:D141-D145 (2008).
Collins & Bercik, "The Relationship Between Intestinal Microbiota and the Central Nervous System in Normal Gastrointestinal Function and Disease," Gastroenterology, 136:2003-2014 (2009).
Collins, et al., "The Phylogeny of the Genus Clostridium: Proposal of Five New Genera and Eleven New Species Combinations," International Journal of Systematic Bacteriology, pp. 812-826 (1994).
Constantino, et al., "Validation of a Brief Quantitative Measure of Autistic Traits: Comparison of the Social Responsiveness Scale with the Autism Diagnostic Interview—Revised," J. Autism Dev. Disord., 33(4):427-433 (2003).
Crohn's Disease, Prevention, Health Guide A-Z, WebMDHealth, pp. 1-2, n.d., Web, Oct. 23, 2005 http://mywebmd.com/hw/inflammatory.sub.--bowel/uf6012.asp.
Crowther, "Transport and Storage of Faeces for Bacteriological Examination," Journal of Applied Bacteriology, 34(2):477-483 (1971).
Cutolo, et al., "Fecal feedings as a therapy in *Staphylococcus enterocolitis,"* NY State J Med, 59:3831-3833 (1959).
Dale, et al., "Molecular interactions between bacterial symbionts and their hosts," Cell, 126(3):453-465 (2006).
Dan, et al., "Comparison of preservation media and freezing conditions for storage of specimens of faeces," J. Med Microbiology, 28:151-154 (1989).
De Giulio, et al., "Use of Algiinate and Cryo-Protective Sugars to Improve the Viability of Lactic Acid Bacteria After Freezing and Freeze-Drying," World Journal of Microbiology & Biotechnology, 21:739-746 (2005).
Defang, et al., "In vitro and in vivo evaluation of two extended release preparations of combination metformin and glipizide," Drug Develop. & Indust. Pharm., 31:677-685 (2005).
Definition of Kit, Merriam-Webster, pp. 1-10., Web., 2019, https://www.merriam-webster.com/dictionary/kit.
Dendukuri, et al., "Probiotic therapy for the prevention and treatment of Clostridium difficile-associated diarrhea: a systematic review," CMAJ, 173(2):167-170 (2005).
Derrien, et al., "*Akkermansia muciniphila* gen. nov., sp. Nov., a human intestinal mucin-degrading bacterium," International Journal of Systematic and Evolutionary Microbiology, 54:1469-1476 (2004).
Derwent Abstract Accession No. 98-230427/20, WO 98/13068 A, (Kuperman VB) Apr. 2, 1998.
Dethlefsen, et al., "An ecological and evolutionary perspective on human-microbe mutualism and disease," Nature, 449(7164):811-818 (2007).
D'Eufemia, et al., "Abnormal intestinal permeability in children with autism," Acta Paediatr, 85:1076-1079 (1996).
Dewhirst, et al., "Phylogeny of the Defind Murine Microbiota: Altered Schaedler Flora," Applied and Environmental Microbiology, 65(8):3287-3292 (1999).
Dieterle, et al., "Renal biomarker qualification submission: a dialog between the FDA-EMEA and Predictive Safety Testing Consortium," Nature Biotechnology 28(5):455-462 (2010).
Dorn, et al., "Invasion of Human Oral Epithelial Cells by Prevotella intermedia," 66(12):6054-6057 (1998).
Duncan, et al., "Acetate Utilization and Butyryl Coenzyme A (CoA): Acetate-CoA Transferase in Butyrate-Producing Bacteria from the Human Large Intestine," Applied and Environmental Microbiology, 68(10):5186-5190 (2002).
Dupont, "The search for effective treatment of Clostridium difficile infection," N Engl J Med., 364(5):473-475 (2011).
Eckburg, et al., "Diversity of the human intestinal microbial flora," Science, 308(5728):1635-1638 (2005).

(56) References Cited

OTHER PUBLICATIONS

Edgar, "Search and clustering orders of magnitude faster than BLAST," Bioinformatics 26(19):2460-2461 (2010).
Eiseman, et al., "Fecal enema as an adjunct in the treatment of pseudomembranous enterocolitis," Surgery, 44(5):854-859 (1958).
Eller, et al., "Anaerobic Roll Tube Media for Nonselective Enumeration and Isolation and Bacteria in Human Feces," Applied Microbiology 1971, vol. 22, p. 522-529.
Extended European Search Report dated Apr. 3, 2014, in European Patent Application No. 11813951.8.
Extended European Search Report dated Mar. 16, 2018, in European Patent Application No. 17203052.0.
Extended European Search Report dated Nov. 30, 2016, in European Patent Application No. 16193790.9.
Faust, et al., "Treatment of recurrent pseudomembranous colitis (RPMC) with stool transplantation (ST): Report of six (6) cases," Can J Gastroenterol., 16:A43 (2002).
Zhang, et al., "Altered gut microbiome composition in children with refractory epilepsy after ketogenic diet," Epilepsy Research (2018) https://doi.org/10.1016/j.eplepsyres.2018.06.15.
Zhang, et al., "Human gut microbiota in obesity and after gastric bypass," PNAS, 106(7):2365-2370 (2009).
Zhao, et al., "Gut Microbiota Composition Modifies Fecal Metabolic Profiles in Mice," Journal of Proteome, 12:2987-2999 (2013).
Zheng, et al., "The Footprints of Gut Microbial—Mammalian Co-Metabolism," Journal of Proteome, 10:5512-5522 (2011).
Zhou, et al., "Total fecal microbiota transplantation alleviates high-fat diet-induced steatohepatitis in mice via beneficial regulation of gut microbiota," Scientific Reports (Nature), 7(1529):1-11 (2017).
Zhu, et al., "Altered giutathione homeostasis in animals prenatally exposed to lipopolysaccharide," Neurochemistry International, 50(4):671-680 (2007).
Zilberberg, et al., "Clostridium difficile Infections among Hospitalized Children, United States, 1997-2006," Emerg. Infect. Dis, 16(4):604-609 (2010).
Zilberberg, et al., "Clostridium difficile-related Hospitalizations among US Adults, 2006," Emerg. Infect. Dis, 15(1):122-124 (2009).
Zilberberg, et al., "Increase in Adult Clostridium difficile-related Hospitalizations and Case-Fatality Rate, United States, 2000-2005," Emerg. Infect. Dis, 14(6):929-931 (2008).
Zilberberg, et al., "Increase in Clostridium difficile-related Hospitalizations Among Infants in the United States, 2000-2005," Pediatr Infect Dis J., 27(12):1111-1113 (2008).
Zoppi, et al., "Oral Bacteriotherapy in Clinical Practice," Eur J. Pediatr, 139(1):18-21 (1982).
Zoppi, et al., "The Intestinal Ecosystem in Chronic Functional Constipation," ACTA Paediatr, Scandinavian University Press, p. 836-841 (1998).
Blaser, et al., "What are the consequences of the disappearing human microbiota?" Nat. Rev. Microbiol., 7(12):887-894 (2009).
Blaser, "Who are we? Indigenous microbes and the ecology of human diseases," EMBO Rep, 7(10):956-960 (2006).
Bolte, "Autism and Clostridium tetani," Medical Hypotheses, 51(2):133-144 (1998).
Bolte, "Therapies for Gastrointestinal and Neurological Disorders," U.S. Appl. No. 60/214,813, filed Jun. 28, 2000.
Borody, et al., "The GI Microbiome and its Role in Chronic Fatigue Syndrome: a Summary of Bacteriotherapy," ACNEM Journal, 31(3):3-8 (2012).
Borody, et al., "Anti-MAP Rescues Anti-TNF Failures for Over 4 Years," Gastroenterol, 136(5)Suppl 1:A-681 (2009).
Borody, et al., "Anti-MAP Therapy for Pediatric Crohn's Disease," Am J Gastroenterol, 108(Suppl 1):S516 (2013).
Borody, et al., "Anti-MAP Therapy in the Treatment of Active Crohn's Disease," J Gastroenterol & Hepatol, 20(Suppl):A2 (2005).
Borody, et al., "Anti-mycobacterial therapy in Crohn's disease heals mucosa with longitudinal scars," Digestive & Liver Disease, 39(5):438-444 (2007).
Borody, et al., "Anti-*Mycobacterium avium* SS *Paratuberculosis* (MAP) Therapy and Fistula Closure in Patients with Severe Crohn's Disease," Am J Gast, A101:S440 (2006).
Borody, et al., "Bacteriotherapy in Chronic Fatigue Syndrome (CFS): A retrospective review," Am J Gastro, 107(S1):A1481 (2012).
Borody, et al., "Bacteriotherapy Using Fecal Flora: toying with human motions" J. Clin. Gastroenterol., 38(6):475-483 (2004).
Borody, et al., "Bowel-flora alteration: a potential cure for inflammatory bowel disease and irritable bowel syndrome?" Med. J. Aust., 150:604 (1989).
Borody, et al., "Changes in Crohn's Disease Activity Index and C-Reactive Protein Levels During Anti-MAP Therapy," Am J Gastro, 104(S3):A1293 (2009).
Borody, et al., "Clostridium difficile Complicating Inflammatory Bowel Disease: Pre- and Post-Treatment Findings," Gastroenterol, 134(4)Suppl 1:A-361 (2008).
Borody, et al., "Could fecal microbiota transplantation cure all Clostridium difficile infections?," Future Microbiol, 9:1-3 (2014).
Borody, et al., "Entamoeba histolytica: another cause of Crohn's Disease," Am J Gastro, 104(S3):A990 (2009).
Borody, et al., "Faecal bacteriotherapy (FB) for chronic C. difficile (Cd) syndromes," J Gastroenterol Hepatol, 18(Suppl.):B8 (Abstract) (2003).
Borody, et al., "Fecal bacteriotherapy in the treatment of recurrent C. difficile infection," UpToDate, pp. 1-6 (2006).
Borody, et al., "Fecal Microbiota Transplantation (FMT) in Multiple Sclerosis (MS)," Am J Gastro, 106(S2):A942 (2011).
Borody, et al., "Fecal microbiota transplantation and emerging applications," Nat. Rev. Gastroenterol. Hepatol., 9(2):88-96 (2011).
Borody, et al., "Fecal microbiota transplantation for Clostridium difficile infection: A surgeon's perspective" Seminars in Colon and Rectal Surgery, 25:163-166 (2014).
Borody, et al., "Fecal microbiota transplantation in gastrointestinal diseases—What practicing physicians should know," Polish Archives of Internal Medicine, 125(11):852-858 (2015).
Borody, et al., "Fecal microbiota transplantation in the treatment of recurrent Clostridium difficile infection," UpToDate, pp. 1-4, (2015).
Borody, et al., "Fecal Microbiota Transplantation in Ulcerative Colitis: Review of 24 Years Experience," Am J Gastro, 107(Supp 1):A1644 (2012).
Borody, et al., "Fecal microbiota transplantation: a new standard treatment option for Clostridium difficile infection," Expert Rev Anti Infect Ther., 11(5):447-449 (2013).
Borody, et al., "Fecal microbiota transplantation: current status and future directions," Expert Review of Gastroenterology & Hepatology, 5(6):653-655 (2011).
Borody, et al., "Fecal Microbiota Transplantation: Expanding Horizons for Clostridium difficile Infections and Beyond," Antibiotics, 4:254-266 (2015).
Borody, et al., "Fecal Microbiota Transplantation: Indications, Methods, Evidence, and Future Directions," Curr Gastroenterol Rep, 15:337-344 (2013).
Borody, et al., "Fecal Microbiota Transplantation: Techniques, Applications, and Issues," Gastroenterol Clin North Am, 41:781-803 (2012).
Borody, et al., "Irritable Bowel Syndrome and Dientamoeba Fragilis," ASM Sydney National Conference, pp. 4-5 (2002).
Borody, et al., "Is Crohn's Disease Ready for Fecal Microbiota Transplantation?," J Clin Gastroenterol, 48(7):582-583 (2014).
Borody, et al., "Myoclonus-dystonia affected by GI Microbiota?" Am J Gastro, 106(S2):A940 (2011).
Borody, et al., "Novel appearance of healing mucosa following anti-*Mycobacterium avium* paratuberculosis therapy for Crohn's disease," J Gastroenterol Hepatol, 19(Suppl):A210 (2004).
Borody, et al., Reversal of Idiopathic Thrombocytopenia Purpura [ITP] with Fecal Microbiota Transplantation [FMT], Am J Gastro, 106(S2):A941 (2011).
Borody, et al., "Reversal of Inflammatory Bowel Disease (IBD) with Recurrent Faecal Microbiota Transplants (FMT)," Am J Gastro, 106(S2):A979 (2011).

(56) References Cited

OTHER PUBLICATIONS

Borody, et al., "Severe recurrent Crohn's Disease of ileocolonic anastomosis and antimicrobial (anti-mycobacterial therapy)," Gut, 55:1211 (2006).
Borody, et al., "Therapeutic faecal microbiota transplantation: current status and future developments," Curr Opin Gastroenterol, 30:97-105 (2014).
Borody, et al., "Treatment of chronic constipation and colitis using human probiotic infusions," Proceedings of Prebiotics and Probiotics and the New Foods Conference, 2-4:228 Abstract (2001).
Borody, et al., "Treatment of First-time Clostridium difficile Infection with Fecal Microbiota Transplantation," Poster Presentation, 2015 ACG Annual Scientific Meeting, Honolulu, Hawaii, USA (2015).
Borody, et al., "Treatment of Severe Constipation Improves Parkinson's Disease (PD) Symptoms," Am J Gastro, 104(S3):A999 (2009).
Borody, et al., "Treatment of Severe Crohn's Disease (CD)—Using Rifabutin-Macrolide-Clofazimine Combination: Results at 30-37 Months," Gastroenterology, 118(4):A1334 Abstract (2000).
Borody, et al., Treatment of Severe Crohn's Disease Using Rifabutin-Macrolide-Clofazimine Combination—Results at 38-43 Months, J Gastroenterol & Hepatol, 15(Suppl.):J102 (2000).
Borody, et al., "Treatment of Severe Crohn's disease using antimycobacterial triple therapy—approaching a cure?" Digest Liver Dis, 34(1):29-38 (2002).
Borody, et al., "Treatment of ulcerative colitis using fecal bacteriotherapy," J. Clin. Gastroenterol., 37(1):42-47 (2003).
Borody, "Bacteriotherapy for Chronic Fatigue Syndrome—A Long Term Follow-Up Study," Proceedings of ACMA Complementary Medicine Sydney, p. 1 (1995).
Borody, "Flora Power"—Fecal Bacteria Cure Chronic C. difficile Diarrhoea, Am J Gastroenterol, 95(11):3028-3029 (2000).
Borody, "Is the Infected Patient too 'Difficile' to Treat?," The Australian Society for Microbiology 2009 Perth, SY03 & SY03.1, p. 27 & 56, (2009).
Borody, "Letter to the Editor—Response to Drs. Famularo et al.," AJG, 96(7):2262-2264 (2001).
Borriello, "Clostridial Disease of the Gut," Clinical Infectious Diseases, The University of Chicago, 20(Suppl 2):S242-S250 (1995).
Bowden, et al., "Pseudomembraneous enterocolitis: mechanism of restoring floral homeostasis," Am Surg., 47(4):178-183 (1981).
Brandt, et al., "Long-Term Follow-Up Study of Fecal Microbiota Transplantation (FMT) for Ulcerative Colitis (UC)," Am. J. Gastroenterol., 107(Suppl I):S657 (2012).
Brandt, et al., "Endoscopic Fecal Microbiota Transplantation: "First-Line" Treatment for Severe Clostridium difficile Infection?" J. Clin. Gastroenterol., 45(8):655-657 (2011).
Brandt, et al., "Fecal microbiota transplantation for recurrent Clostridium difficile infection," J Clin Gastroenterol., 45(Suppl):S159-S167 (2011).
Brandt, et al., Safety of Fecal Microbiota Transplantation (FMT) in Immunocompromised (IC) Patients with Inflammatory Bowel Disease (IBD), Am J Gastroenterol, 108(Suppl 1):S556 (2013).
Browne, et al., "Culturing of 'unculturable' human microbiota reveals novel taxa and extensive sporulation," Nature, 533(7604):543-546 (2016).
Bryant, et al., "*Bacteroides ruminicola* N. Sp. And the new Genus and Species *Succinimonas amylolytica*," Journal of Bacteriol, 76:15-23 (1958).
Bueche, et al., "Quantification of Endospore-Forming Firmicutes by Quantitative PCR with the Functional Gene spo0A," Applied and Environmental Microbiology, 79(17):5302-5312 (2013).
International Preliminary Report on Patentability completed Mar. 12, 2015, in International Application No. PCT/AU2013/001362, 29 pgs.
International Preliminary Report on Patentability dated Sep. 10, 2013, in International Application No. PCT/US2012/028484, 10 pgs.
International Search Report and the Written Opinion dated Aug. 22, 2016, in International Application No. PCT/US2016/033747.
International Search Report and Written Opinion (WO) dated Feb. 2, 2018 in International Application No. PCT/US2017/055618.
International Search Report and Written Opinion (WO) dated Feb. 2, 2018 in International Application No. PCT/US2017/056131.
International Search Report and Written Opinion (WO) dated Feb. 21, 2018 in International Application No. PCT/US2017/056129.
International Search Report and Written Opinion (WO) dated Feb. 26, 2018 in International Application PCT/US2017/061104.
International Search Report and Written Opinion (WO) dated Jan. 17, 2018, in International Application No. PCT/US2017/045092.
International Search Report and Written Opinion (WO) dated Jan. 31, 2018 in International Application PCT/US2017/056126.
International Search Report and Written Opinion dated Aug. 17, 2018, in International Application No. PCT/US2018/034673.
International Search Report and Written Opinion dated Aug. 2, 2018, in International Application No. PCT/US2018/026074.
International Search Report and Written Opinion dated Jul. 30, 2018, in International Application No. PCT/US2018/026080.
International Search Report and Written Opinion dated Aug. 8, 2016, in International Application No. PCT/US2016/032695, 10 pgs.
International Search Report and Written Opinion dated Feb. 5, 2014, in International Application No. PCT/AU2013/001362, 17 pgs.
International Search Report and Written Opinion dated Jan. 5, 2017, in International Application No. PCT/US2016/058938.
International Search Report and Written Opinion dated Jul. 31, 2014, in International Application No. PCT/US2014/027391, 16 pgs.
International Search Report and Written Opinion dated Oct. 28, 2011, in International No. PCT/AU2011/000987, 18 pgs.
International Search Report dated Aug. 10, 2012, in International Application No. PCT/US2012/028484, 7 pgs.
International Search Report dated Jul. 29, 2014, in International Application No. PCT/AU2014/000478, 7 pgs.
International Search Report dated Jul. 5, 2013, in International Application No. PCT/US2013/032668, 4 pgs.
International Search Report dated Sep. 22, 2017, in International Application No. PCT/US2017/040591, 12 pgs.
Irrgang, et al., "The historical Development of Mutaflor therapy," Ardeypharm GmbH, pp. 1-38 (1988) http://www.ardeypharm.de/pdfs/en/mutaflor_historical_e.pdf?.
Irritable Bowel Syndrome (IBS), Health A to Z, InteliHealth, pp. 1-4, n.d., Web, Oct. 23, 2005 http://www.intelihealth.com.
Issa, et al., "Clostridium difficile and Inflammatory Bowel Disease," Inflamm Bowel Dis., 14(10):1432-1442 (2008).
Issa, et al., "Impact of Clostridium difficile on inflammatory bowel disease," Clin. Gastroenterol. Hepatol., 5(3):345-351 (2007).
Itoh, et al., "Characterization of clostridia isolated from faeces of limited flora mice and their effect on caecal size when associated with germ-free mice," Laboratory Animals, 19:111-118 (1985).
Itoh, et al., "Intestinal bacteria antagonistic to Clostridium difficile in mice," Laboratory Animals, 21:20-25 (1987).
Ivanov, et al., "Induction of intestinal Th17 cells by segmented filamentous bacteria," Cell, 139(3):485-498 (2009).
Ivanov, et al., "Specific Microbiota Direct the Differentiation of IL-17-Producing T-Helper Cells in the Mucosa of the Small Intestine," Cell Host & Microbe, 4:337-349 (2008).
Jacob, et al., "Single Delivery of High-Diversity Fecal Microbiota Preparation by Colonoscopy Is Safe and Effective in Increasing Microbial Diversity in Active Ulcerative Colitis," Inflamm Bowel Dis., 0(0):1-9 (2017).
James, et al., "Metabolic biomarkers of increased oxidative stress and impaired methylation capacity in children with autism," American Journal of Clinical Nutrition, 80:1611-1617 (2008).
Janeway, et al., "Adaptive Immunity to Infection," Immunobiology, 6th Edition, Chapter 10, pp. 414 (2005).
Janeway, Jr., et al., "Autoimmune responses are directed against self antigens," Immunobiology: The Immune System in Health and Disease, 5th Edition, pp. 1-4 (2001).

(56) References Cited

OTHER PUBLICATIONS

Jarvis, et al., "National point prevalence of Clostridium difficile in US health care facility inpatients, 2008," Am. J. Infect. Control, 37:263-270 (2009).
Jia, et al., "Gut microbiota: a potential new territory for drug targeting," Nature Reviews—Drug Discovery, 7:123-129 (2008).
Johnson, et al., "Interruption of Recurrent Clostridium difficile-Associated Diarrhea Episodes by Serial Therapy with Vancomycin and Rifaximin," Clin. Infect. Dis., 44(6):846-848 (2007).
Johnson, et al., "Rifaximin Redux: Treatment of recurrent Clostridium difficile infections with Rifaximin immediately post-vancomycin treatment," Anaerobe, 15(6):290-291 (2009).
Kageyama, et al., "Emendation of genus *Collinsella* and proposal of *Collinsella stercoris* sp. nov. and *Collinsella intestinalis* sp. nov.," International Journal of Systematic and Evolutionary Microbiology, 50:1767-1774 (2000).
Kageyama, et al., "Phylogenetic and phenotypic evidence for the transfer of Eubacterium aerofaciens to the genus *Collinsella* as *Collinsella aerofaciens* gen. nov., comb. nov.," International Journal of Systematic Bacteriology, 49:557-565 (1999).
Kakihana, et al., "Fecal microbiota transplantation for patients with steriod-resistant acute graft-versus-host disease of the gut," Blood, 128(16):2083-2088 (2016).
Kamboj, et al., "Relapse versus reinfection: surveillance of Clostridium difficile infection," Clin Infect Dis., 53(10):1003-1006 (2011).
Kang, et al., "Microbiota Transfer Therapy alters gut ecosystem and improves gastrointestinal and autism symptoms: and open-label study," Microbiome, 5:10, 16 pages (2017).
Kang, et al., "Reduced Incidence of Prevotella and Other Fermenters in Intestinal Microflora of Autistic Children," PLOS One, 8(7):e68322, 14 pages (2013).
Kaper, et al., "Pathogenic *Escherichia Coli,*" Nature Reviews—Microbiology, 2:123-140 (2004).
Karas, et al., "A review of mortality due to Clostridium difficile infection," J Infect., 61(1):1-8 (2010).
Kassam, et al., "Fecal transplant via retention enema for refractory or recurrent Clostridium difficile infection," Arch Intern Med., 172(2):191-193 (2012).
Kelly, et al., "Commensal gut bacteria: mechanisms of immune modulation," TRENDS in Immunology, 26(6):326-333 (2005).
Kelly, et al., "Clostridium difficile—more difficult than ever," N. Engl. J. Med., 359(18):1932-1940 (2008).
Kelly, et al., "Clostridium difficile colitis," N. Engl. J. Med., 330(4):257-62 (1994).
Kelly, et al., "Fecal Microbiota Transplant for Treatment of Clostridium difficile Infection in Immunocompromised Patients," Am J Gastroenterol, 109:1065-1071 (2014).
Kelly, et al., "Fecal microbiota transplantation for relapsing Clostridium difficile infection in 26 patients: methodology and results," J. Clin. Gastroenterol., 46(2):145-149 (2012).
Keynan, et al., "The Role of Regulatory T Cells in Chronic and Acute Viral Infections," Clinical Infectious Diseases, 46:1046-1052 (2008).
Khanna, et al., "A Novel Microbiome Therapeutic Increases Gut Microbial Diversity and Prevents Recurrent Clostridium difficile Infection," The Journal of Infectious Diseases, 214:173-81 (2016).
Khanna, et al., "The epidemiology of community-acquired Clostridium difficile infection: a population-based study," Am J Gastroenterol., 107(1):89-95 (2012).
Khanna, et al., "The growing incidence and severity of Clostridium difficile infection in inpatient and outpatient settings," Expert Rev Gastroenterol Hepatol., 4(4):409-16 (2010).
Kharidia, et al., "The Activity of a Small Lytic Peptide PTP-7 on *Staphylococcus aureus* Biofilms," J. Microbiol., 49(4):663-668 (2011).
Khoruts, et al., "Changes in the composition of the human fecal microbiome after bacteriotherapy for recurrent Clostridium difficile-associated diarrhea," J. Clin. Gastroenterol., 44(5):354-360 (2010).
Khoruts, et al., "Therapeutic transplantation of the distal gut microbiota," Mucosal Immunol., 4(1):4-7 (2011).
Zoppi, et al., "Oral Bacteriotherapy in Clinical Practice," Eur J. Pediatr, 139(1):22-24 (1982).
Genbank, "Uncultured bacterium clone TS28_a01a05 16S ribosomal RNA gene, partial sequence," GenBank accession No. FJ366885. 1, Jan. 22, 2009.
International Search Report and Written Opinion, PCT Application No. PCT/US2018/045593, dated Oct. 29, 2018, 12 pages.
Turnbaugh, et al., "The core gut microbiome in obese and lean twins," Nature, vol. 457, No. 7228, Jan. 22, 2009, 16 pages.
Kim, et al., "Effect of Rifampin on the Plasma Concentration and the Clinical Effect of Haloperidol Concomitantly Administered to Schizophrenic Patients," Journal of Clinical Psychopharmacology, 16(3):247-252 (1996).
Kim, et al., "In Vitro Culture Conditions for Maintaining a Complex Population of Human Gastrointestinal Tract Microbiota," Journal of Biomedicine and Biotechnology, 2011(Article ID 838040):1-10 (2011) http://www.hindawi.com/journals/bmri/2011/838040/.
Kitajka, et al., "Effects of dietary omega-3 polyunsaturated fatty acids on brain gene expression," PNAS, 101(30):10931-10936 (2004).
Klaenhammer, "Bacteriocins of lactic acid bacteria," Biochimie, 70:337-49 (1988).
Kleiman, et al., "Comparison of two coprological methods for the veterinary diagnosis of fasciolosis," Arquivo Brasileiro de Medicina Veterinária e Zootécnica, 55(2):181-185 (2005).
Kobashi, et al., "Metabolism of Sennosides by Human Intestinal Bacteria," Journal of Medicinal Plant Research, 40(3):225-236 (1980).
Koch, "What size should a bacterium be? A question of scale," Annu. Rev. Microbiol., 50:317-48 (1996).
Kostic, et al., "Genomic analysis identifies association of Fusobacterium with colorectal carcinoma," Genome Research 22:292-298 (2011).
Krogius-Kurikka, et al., "Sequence analysis of percent G+C fraction libraries of human faecal bacterial DNA reveals a high number of Antinobacteria," BMC Microbiology, 9(68):1-13 (2009).
Kuijper, et al. "Update of Clostridium difficile Infection due to PCR Ribotype 027 in Europe, 2008," Euro. Surveill., 13(31):Article 5 (2008).
Kuksal, et al., "Formulation and In Vitro, In Vivo Evaluation of Extended-release Matrix Tablet of Zidovudine: Influence of Combination of Hydrophilic and Hydrophobic Matrix Formers," AAPS Pharm., 7(1):E1-E9 (2006).
Kunde, et al., "Safety, Tolerability, and Clinical Response After Fecal Transplantation in Children and Young Adults With Ulcerative Colitis," JPNG, 56(6):597-601 (2013).
Kushak, et al., "Intestinal disaccharidase activity in patients with autism," Autism, 15(3):285-294 (2011).
Kyne, et al., "Association between antibody response to toxin A and protection against recurrent Clostridium difficile diarrhea," Lancet, 357(9251):189-93 (2001).
Kyne, et al., "Asymptomatic carriage of Clostridium difficile and serum levels of IgG antibody against toxin A," N Engl J Med., 342(6):390-397 (2000).
Kyne, et al., "Factors associated with prolonged symptoms and severe disease due to Clostridium difficile," Age and Ageing, 28(2):107-13 (1999).
Kysela, et al., "Serial analysis of V6 ribosomal sequence tags (SARST-V6): a method for efficient, high-throughput analysis of microbial community composition," Environmental Microbiology, 7(3):356-364 (2005).
Kyselova, et al., "Alterations in the Serum Glycome Due to Metastatic Prostate Cancer," Journal of Proteome Research, 6:1822-1832 (2007).
Labbé, et al., "Clostridium difficile infections in a Canadian tertiary care hospital before and during a regional epidemic associated with the BI/NAP1/027 strain," Antimicrob Agents Chemother., 52(9):3180-7 (2008).
Lamontagne, et al., "Impact of emergency colectomy on survival of patients with fulminant Clostridium difficile colitis during an epidemic caused by a hypervirulent strain," Ann. Surg., 245(2):267-272 (2007).

(56) References Cited

OTHER PUBLICATIONS

Larsen, et al., "Gut Microbiota in Human Adults with Type 2 Diabetes Differs from Non-Diabetic Adults," PLoS ONE, 5(2): e9085 (2010).
Lau, et al., "Bacteraemia caused by Anaerotruncus colihominisand emended description of the species," J Clin Pathol, 59:748-752 (2006).
Lawson, et al., "*Anaerotruncus colihominis* gen. nov., sp. nov., from human faeces," International Journal of Systematic and Evoluntionary Microbiology, 54:413-417 (2004).
Lawson, et al., "Anaerotruncus," Bergey's Manual of Systematics of Archae and Bacteria, pp. 1-4 (2009).
Lederberg, "Infectious History", Science, 288(5464):287-293 (2000).
Lee & Mazmanian, "Has the Microbiota Played a critical Role in the Evolution of the Adaptive Immune System?," 330:1768-1773 (2010).
Lee, et al., "Discriminative prediction of mammalian enhancers from DNA sequence," Genome Research 21:2167-2180 (2011).
Lee, et al., "Prioritizing candidate disease genes by network-based boosting of genome-wide association data," Genome Research, 21(1):1109-1121 (2011).
Lee, et al., "The outcome and long-term follow-up of 94 patients with recurrent and refractory Clostridium difficile infection using single to multiple fecal microbiota transplantation vie retention enema," European Journal Clinical Microbiology Infect Dis., 33:1425-1428 (2014).
Lee, "A Prospective Randomized Multi-Centre Trial of Fresh vs. Frozen-and-Thawed Human Biotherapy (Fecal Transplant) for Recurrent Clostridium difficile Infection," U.S. National Institutes of Health, Clinical Study No. NCT01398969, pp. 1-4, last updated Feb. 27, 2014, Web, May 20, 2014 http://clinicaltrials.gov/ct2/show/NCT01398969.
Leis, et al., "Fecal microbiota transplantation: A 'How-To' guide for nurses," Collegian, 22:445-451 (2015).
Leslie, et al., "Trehalose and Sucrose Protect Both Membranes and Proteins in Intact Bacteria during Drying," Applied and Environmental Microbiology, 61:3592-3597 (1995).
Lewis, et al., "Stool form scale as a useful guide to intestinal transit time," Scand. J. Gastroenterol., 32(9):920-924 (1997).
Ley, et al., "Ecological and evolutionary forces shaping microbial diversity in the human intestine," Cell, 124:837-848 (2006).
Ley, et al., "Evolution of mammals and their gut microbes," Science, 320(5883):1647-1651 (2008).
Ley, et al., "Microbial ecology: human gut microbes associated with obesity," Nature, 444(7122):1022-3 (2006).
Ley, et al., "Worlds within worlds: evolution of the vertebrate gut microbiota," Nat. Rev. Microbiol., 6(10):776-788 (2008).
Lin, et al., "Twelve Week Storage Trial of Microbial Viability in Lyophilized and Frozen Fecal Microbiota Preparations," Poster Presentation—Digestive Disease Week 2015, Washington, D.C. USA.
Longstreth, "Irritable bowel syndrome: A multibillion-dollar problem," Gastroenterology, 109(6):2029-2031 (1995).
Lonsdale, et al., "Treatment of autism spectrum children with thiamine tetrahydrofurfuryl disulfide: A pilot study," Neuroendocrinology Letters, 23:303-308 (2002).
Loo, et al., "A predominantly clonal multiinstitutional outbreak of Clostridium difficile-associated diarrhea with high morbidity and mortality," N Engl J Med, 353(23):2442-9 (2005).
Loo, et al., "Host and pathogen factors for Clostridium difficile infection and colonization," N Engl J Med, 365(18):1693-703 (2011).
Louie, et al., "Fidaxomicin versus vancomycin for Clostridium difficile infection," N. Engl. J. Med., 364(5):422-431 (2011).
Louie, et al., "Home-based fecal flora infusion to arrest multiply-recurrent C. difficile infection," ICAAC/IDSA Conference, Abstract #K-4201 (2008).
Louis, et al., "Diversity, metabolism and microbial ecology of butyrate-producing bacteria from the human large intestine," FEMS Microbiology Letters, 294:1-8 (2009).
Lu, "Taboo transplant: How new poo defeats superbugs," Science News, 1:90-91 (2011).
Ludwig, et al., "Taxonomic outline of the phylum Firmicutes," Bergey's Manual of Systematic Bacteriology, 3:15-17 (2009).
Lund-Tonnesen, et al., "Clostridium difficile-associated diarrhea treated with homologous faeces," Tidsskr Nor Lageforen, 118:1027-1030 (1998), abstract translated only.
MacConnachie, et al., "Faecal transplant for recurrent Clostridium difficile-associated diarrhoea: a UK case series," QJM, 102(11):781-784 (2009).
MacDonald, et al., "Formation of Ursodeoxycholic Acid from Chenodeoxycholic Acid by a 7β-Hydroxysteroid Dehydrogenase-Elaborating Eubacterium aerofaciens Strain Cocultured with 7α-Hydroxysteroid Dehydrogenase- Elaborating Organisms," Applied and Environmental Microbiology, 44(5):1187-1195 (1982).
MacFabe, et al., "Short-chain fatty acid fermentation products of the gut microbiome: implications in autism spectrum disorders," Microbial Ecology in Health & Disease, 23:19260 (2012).
MacPherson, et al., "Induction of Protective IgA by Intestinal Dendritic Cells Carrying Commensal Bacteria," Science, 303:1662-1665 (2004).
Madsen, "The use of probiotics in gastrointestinal disease," Can J Gastroenterol, 15(12):817-22 (2001).
Magistris, et al., "Alterations of the Intestinal Barrier in Patients with Autism Spectrum Disorders and in Their First-degree Relatives," Gastroenterology 51(4):418-424 (2010).
Maizels, et al., "Regulatory T cells in Infection," Advances in Immunology, Chapter 3, 112:73-136 (2011).
Manichanh, et al., "Reshaping the gut microbiome with bacterial transplantation and antibiotic intake," Genome Research 20:1411-1419 (2010).
Marchesi, et al., "The normal intestinal microbiota," Curr. Opin. Infect. Dis., 20(5):508-513 (2007).
Martin, "Development and Delivery of a Treatment for Clostridium difficile," Bacteriotherapy, pp. 1-2, n.d., Web, Feb. 10, 2012 www.bacteriotherapy.org.
"ARGF—'Autologous Rehabilitation of Gastrointestinal Flora,'" Medipex Report for Medilink NW, pp. 1-42, n.d., Web, Feb. 10, 2012 http://www.bacteriotherapy.org/docs/medipex-report.pdf.
"Autoimmune Disease List," American Autoimmune Related Diseases Association, pp. 1-4 (2017) https://www.aarda.org/diseaselist/.
"Certain infectious and parasitic diseases (A00-B99)," International Statistical Classification of Diseases and Related Health Problems, 10th Revision (ICD-10)—WHO Version, Chapter 1, p. 1 (2016) www.apps.who.int/classifications/icd10/browse/2016/en#/1.
"Frequently Asked Questions about Clostridium difficile for Healthcare Providers," Healthcare-associated Infections (HAIs), Centers for Disease Control and Prevention, pp. 1-6, Nov. 25, 2010, updated Mar. 6, 2012, Web, May 19, 2014 http://www.cdc.gov/HAI/organisms/cdiff/Cdiff_faqs_HCP.html.
"Functional Anatomy of Prokaryotic and Eukaryotic Cells," printed Mar. 16, 2017 from http://classes.midlandstech.edu/carterp/courses/bio225/chap04/lecture2.htm.
"Monilia," Def. 1, Stedman's Medical Dictionary, n.d., Web, Nov. 22, 2005.
"Probiotic," Def. 1, MSN Encarta—Dictionary, Encarta, n.d., Web, Dec. 1, 2005.
"Spore-Forming Gram-Positive Bacilli: Bacillus and Clostridium Species," Jawetz, Melnick, & Adelberg's Medical Microbiology, 26th Edition, Chapter 11, pp. 1-15 (2012).
"Autism Treatment Evaluation Checklist (ATEC)," Autism Research Institute. https://www.autism.com/ind_atec.
"Studies confirm validity of ATEC Report," Autism Research Institute. https://www.autism.com/ind_atec_report.
Aas, et al., "Recurrent Clostridium difficile Colitis: Case Series Involving 18 Patients Treated with Donor Stool Administered via a Nasogastric Tube," Clinical Infectious Diseases, 36(5):580-585 (2003).
Abrams, "Open-Label, Uncontrolled Trial of Bowel Sterilization and Repopulation with Normal Bowel Flora for Treatment of Inflammatory Bowel Disease," Current Therapeutic Research, 58(12):1001-1012 (1997).

(56) References Cited

OTHER PUBLICATIONS

Acha, et al., "Changes of viability and composition of the *Escherichia coli* flora in faecal samples during long time storage," Journal of Microbiological Methods, Elsevier, 63(3):229-238 (2005).
Adams, et al., "Effect of a Vitamin/Mineral Supplement on Children with Autism," BMC Pediatrics, 11:111 (2011).
Adams, et al., "Gastrointestinal flora and gastrointestinal status in children with autism—comparisons to typical children and correlation with autism severity," BMC Gastroenterology, 11:22 (2011).
Adams, et al., "Mercury in first-cut baby hair of children with autism versus typically-developing children," Toxicological & Environmental Chemistry, 90(4): 739-753 (2008).
Adams, et al., "The Severity of Autism is Associated with Toxic Metal Body Burden and Red Blood Cell Glutathione Levels," J. Toxicol, 2009:532640 (2009).
Agrawal, et al., "'Global warming' to *Mycobacterium avium* subspecies *paratuberculosis*," Future Microbiol, 9(7):829-832 (2014).
Agrawal, et al., "A Long-Term Follow-Up Study of the Efficacy and Safety of Fecal Microbiota Transplant (FMT) for Recurrent/Severe/Complicated C. difficile Infection (CDI) in the Elderly," Gastroenterol, 146(5)(Suppl 1):S42-43 (2014).
Aitken, et al., "Demonstration of Intracellular Mycobacterium Species in Crohn's Disease Using Novel Technologies," Poster Presentation—2015 ACG Annual Scientific Meeting, Honolulu, Hawaii, USA (2015).
Akao, et al., "A Purgative Action of Barbaloin Is Induced by *Eubacterium* sp. Strain BAR, a Human Intestinal Anaerobe, Capable of Transforming Barbaloin to Aloe-Emodin Anthrone," Biol. Pharm., 19(1):136-138 (1996).
Al-Eidan, et al., "Clostridium difficile-associated diarrhoea in hospitalised patients," J. Clin. Pharm. Ther., 25(2):101-109 (2000).
Al-Nassir, et al., "Comparison of Clinical and Microbiological Response to Treatment of Clostridium difficile-Associated Disease with Metronidazole and Vancomycin," Clin Infect Dis., 47(1):56-62 (2008).
Aman, et al., "Outcome Measures for Clinical Drug Trials in Autism," CNS Spectr., 9(1):36-47 (2004).
Aman, et al., "Psychometric Characteristics of the Aberrant Behavior Checklist," Am. J. Ment. Defic., 89(5):492-502 (1985).
Anand, et al., "Epidemiology, clinical manifestations, and outcome of Clostridium difficile-associated diarrhea," Am J Gastroenterol., 89(4):519-23 (1994).
Ananthakrishnan, et al., "Excess hospitalisation burden associated with Clostridium difficile in patients with inflammatory bowel disease," Gut, 57(2):205-210 (2007).
Anderson, et al., "Systematic review: faecal microbiota transplantation in the management of inflammatory bowel disease," Aliment. Pharmacol. Ther., 36:503-16 (2012).
Andoh, et al., "Terminal restriction fragment polymorphisum analyses of fecal microbiota in five siblings including two with ulcerative colitis," Journal of Clinical Gastroenterology, 2:343-345 (2009).
Andrews, et al., "'Putting back the bugs': Bacterial Treatment Relieves Chronic Constipation and Symptoms of Irritable Bowel Syndrome," Med. J. Aust., 159(9):633-634 (1993).
Andrews, et al., "Bacteriotherapy for Chronic Constipation—A Long Term Follow-Up," Gastroenterol, 108:A563 Abstract (1995).
Andrews, et al., "Chronic Constipation (CC) may be reversed by Bacteriotherapy," Gastroenterol, 106:A459 (1994).
Andrews, et al., "Chronic constipation reversed by restoration of bowel flora. A case and a hypothesis," European Journal of Gastroenterology & Hepatology, 4:245-247 (1992).
Anorexia nervosa, Encyclopedia Index A, healthAtoZ, Medical Network, Inc., pp. 1-7, n.d., Web, Nov. 23, 2005 http://www.healthatoz.com/healthatoz/Atoz/ency/anorexia_nervosa.jsp.
Arkkila, et al., "Fecal Bacteriotherapy for Recurrent Clostridium difficile Infection," Gastroenterology, 138(5):S1-S5 (2010).
Aroniadis, et al., "Intestinal Microbiota and the Efficacy of Fecal Microbiota Transplantation in Gastrointestinal Disease," Gastroenterology and Hepatology, 10(4): 230-7 (2014).
Aroniadis, et al., "Long-Term Follow-up Study of Fecal Microbiota Transplantation (FMT) for Severe or Complicated Clostridium difficile Infection (CDI)," Gastroenterol, 144(Suppl 1):S185 (2013).
Arumugam, et al., "Enterotypes of the human gut microbiome," Nature, 473:174-180 (2011).
Atarashi, et al., "Induction of Colonic Regulatory T Cells by Indigenous Clostridium Species," Science, 331(6015):337-341, published online Dec. 23, 2010.
Atarashi, et al., "Treg induction by a rationally selected mixture of Clostridia strains from the human microbiota," Nature, 500(7461):232-236 (2013).
Atarashi, et al., "WS/PP 064-03 Regulation of colonic regulatory T cells by *Clostridium* species," International Immunology, 22(Suppl 1, Part 3), pp. 1-3 (2010).
Atarashi, et al., WS-064 Mucosal immunity: homeostasis, 14th ICIC Abstract book, 14th International Congress of Immunology, pp. iii131-iii133 (2010).
Autism, Health Encyclopedia—Diseases and Conditions, The Health Scout Network, pp. 1-5, n.d., Web, Nov. 22, 2005 www.healthscout.com.
Autism, Treatment, Prognosis, Healthcommunities.com, Inc., pp. 1-4, n.d., Web. Jan. 28, 2009 http://www.neurologychannel.com/common/PrintPage.php.
Autism: Mayo Clinic.com, Mayo Foundation for Medical Education and Research, pp. 1-7, May 31, 2008, Web. Jan. 28, 2009 http://www.mayoclinic.com/print/autism/DS00348/METHOD=print&DSECTION=all.
Backhed, et al., "Host-bacterial mutualism in the human intestine," Science, 307(5717):1915-1920 (2005).
Backhed, et al., "Mechanisms underlying the resistance to diet-induced obesity in germ-free mice," PNAS USA, 104(3):979-984 (2007).
Backhed, et al., "The gut microbiota as an environmental factor that regulates fat storage," PNAS USA, 101(44):15718-15723 (2004).
Bakken, et al., "Fecal bacteriotherapy for recurrent Clostridium difficile infection," Anaerobe, 15(6):285-289 (2009).
Bakken, et al., "Treating Clostridium difficile Infection with Fecal Microbiota Transplantation," Clinical Gastroenterology and Hepatology, 9(12):1044-1049 (2011).
Bartlett, et al., "Clinical recognition and diagnosis of Clostridium difficile infection," Clin Infect Dis., 46(Suppl 1):S12-S18 (2008).
Bartlett, "Clostridium difficile-associated Enteric Disease," Curr Infect Dis Rep., 4(6):477-483 (2002).
Belkaid, et al., "Natural regulatory T cells in infectious disease," Nature Immunology, 6(4):353-360 (2005).
Bengmark, et al., "Bioecological control of inflammatory bowel disease," Clinical Nutrition, 26(2):169-181 (2007).
Bennet, et al., "Treatment of ulcerative colitis by implantation of normal colonic flora," Lancet, 333(8630):164 (1989).
Benson, et al., "Changing epidemiology of Clostridium difficile-associated disease in children," Infect Control Hosp Epidemiol., 28(11):1233-1235 (2007).
Berg, "The indigenous gastrointestinal microflora," Trends Microbiol., 4(11):430-435 (1996).
Bergey's Manual of Systematic Bacteriology, Second Edition, vol. Three, The Firmicutes, pp. 1-16 (2009).
Goodman, "Infectious Diarrhea," Disease-a-Month, vol. 47, No. 7, pp. 266-299, Jul. 1999.
Ngo, et al., "Population-based assessment of the incidence, risk factors, and outcomes of anaerobic bloodstream infections," Infection, vol. 41, No. 1, pp. 41-48, Jan. 5, 2013.
Shi, et al., "The utility of initial procalcitonin and procalcitonin clearance for prediction of bacterial infection and outcome in critically ill patients with autoimmune diseases: a prospective observation study," BMC Anesthesiology, vol. 15, No. 137, 9 pages, 2015.
Cui, et al., Faecal microbiota transplantation protects against radiation-induced toxicity, vol. 9, Issue 4, Apr. 1, 2017, pp. 448-461.
Stefano, et al., Fecal microbiota transplantation (FMT) for Clostridium difficile infection: Focus on immunocomprised patents, Feb. 18, 2015, 41 pages, Di Bella Stefano.

(56) References Cited

OTHER PUBLICATIONS

Tonnesen, et al., Clostridium difficile-associated diarrhea treated with homologous feces, Journal of the Norwegian Medical Association, Mar. 10, 1998, 118(7); 1027-30, 4 pages.
Papanicolas, et al., "Not Just Antibiotics: Is Cancer Chemotherapy Driving Antimicrobial Resistance?" Trends in Microbiology, vol. 26, No. 5, pp. 393-400, May 2018.
Acosta et al., "Effects of Rifaximin on Transit, Permeability, Fecal Microbiome, and Organic Acid Excretion in Irritable Bowel Syndrome," *Clinical and Translational Gastroenterology.* 26;7(5):e173, 1-11 (May 2016).
Andersen et al., "Intestinal Dysbiosis, Barrier Dysfunction, and Bacterial Translocation Account for CKD-Related Systemic Inflammation," *J Am Soc Nephrol JASN.* 28(1): 76-83 (Jan. 2017).
Artis, "Epithelial-cell recognition of commensal bacteria and maintenance of immune homeostasis in the gut," *Nature Reviews Immunology* 8:411-420 (2008).
Ayabe et al., "Secretion of microbicidal alpha-defensins by intestinal Paneth cells in response to bacteria," *Nature Immunology* 1(2):113-118 (Aug. 2000).
Bischoff et al., "Intestinal permeability—a new target for disease prevention and therapy," *BMC Gastroenterology* 14(189): 1-25 (Nov. 2014).
Borody et al., "Fecal microbiota transplantation in gastrointestinal disease: 2015 update and the road ahead," *Expert Review of Gastroenterology and Hepatology,* 9(11):1379-1391 (Sep. 2015).
Brandl et al., "MyD88-mediated signals induce the bactericidal lectin RegIIIgamma and protect mice against intestinal Listeria monocytogenes infection," *Journal of Experimental Medicine* 204(8):1891-1900 (Aug. 2007).
Brandl et al., "Vancomycin-resistant enterococci exploit antibiotic-induced innate immune deficits," *Nature* 455:804-807 (Oct. 2008).
Brandtzaeg, "The gut as communicator between environment and host: immunological consequences," *European Journal of Pharmacology,* 668 Suppl 1:S16-32 (Sep. 2011).
Campbell, "Autoimmunity and the Gut," *Autoimmune Diseases* vol. 2014, Article ID 152428, pp. 1-12 (May 2014).
Chu et al., "Using Propodium Monoazide Sequencing (PMA-Seq) to Develop Data-Driven Best Practices in Fecal Microbiota Transplantations." *Open Forum Infectious Diseases,* 2(1), Oxford University Press, (Dec. 2015) https://academic.oup.com/ofid/article/2/suppl_1/751/2634960.
Di Bella, et al., "Fecal microbiota transplantation (FMT) for Clostridium difficle infection: Focus on immunocompromised patients," *Journal of Infection and Chemotherapy,* vol. 21, No. 4, pp. 230-237 (2015).
Donohoe et al., "Microbial regulation of glucose metabolism and cell-cycle progression in mammalian colonocytes," *PLoS One* 7(9): e46589, 9 pages (Sep. 2012).
Dubin, et al., "Intestinal microbiome analyses identify melanoma patients at risk for checkpoint-blockade-induced colitis," *Nature Communications,* vol. 7, No. 1, pp. 1-8 (Feb. 2016).
Earle et al., "Quantitative Imaging of Gut Microbiota Spatial Organization," *Cell Host Microbe,* 18(4):478-488 (Oct. 2015).
Fessler, et al., "The Microbiota: A New Variable Impacting Cancer Treatment Outcomes," *Clinical Cancer Research,* vol. 23(13): 3229-3231 (Jul. 2017).
Fischer, et al., "Fecal microbiota transplant in severe and severe-complicated Clostridium difficile: A promising treatment approach," *Gut Microbes* 8(3): 289-302 (2017).
Garner et al., "Perturbation of the small intestine microbial ecology by streptomycin alters pathology in a *Salmonella enterica* serovar typhimurium murine model of infection," *Infection and Immunity* 77(7): 2691-2702 (Jul. 2009).
Goverse et al., "Diet-Derived Short Chain Fatty Acids Stimulate Intestinal Epithelial Cells To Induce Mucosal Tolerogenic Dendritic Cells," *The Journal of Immunology* 198(5): 1600165, pp. 2172-2181 (Mar. 2017).
He et al., "Fecal Microbiota Transplantation Cured epilepsy in a Case with Chron's Disease: The First Report," *World Journal of Gastroenterology* (USA), 23(19):3566-3567 (May 2017).
International Search Report and Written Opinion dated Jan. 8, 2020, in International Application No. PCT/U82019/053400, 14 pp.
Itoh et al., "Control of *Escherichia coli* populations by a combination of indigenous Clostridia and Lactobacilli in gnotobiotic mice and continuous-flow cultures," *Infection and Immunity* 57(2): 559-565 (Feb. 1989).
Jones et al., "Anaerobic respiration of *Escherichia coli* in the mouse intestine," Infection and Immunity 79(10): 4218-4226 (Oct. 2011).
Kelly et al., "Crosstalk between microbiota-derived short-chain fatty acids and intestinal epithelial HIF augments tissue barrier function," *Cell Host and Microbe* 17:662-671 (May 2015).
Kinnebrew et al., "Bacterial flagellin stimulates Toll-like receptor 5-dependent defense against vancomycin-resistant Enterococcus infection," *The Journal of Infectious Disease* 201(4):534-543 (Feb. 2010).
Kolls et al., "Cytokine-mediated regulation of antimicrobial proteins," *Nature Reviews Immunology* 8:829-835 (Nov. 2008).
Lin et al., "Abnormal intestinal permeability and microbiota in patients with autoimmune hepatitis," *Int J Clin Exp Pathol.* 8(5):5153-5160 (May 2015).
Macpherson et al., "Interactions between commensal intestinal bacteria and the immune system," *Nature Reviews Immunology* 4:478-485 (Jun. 2004).
Melichar et al., "The significance of altered gastrointestinal permeability in cancer patients," *Curr Opin Support Palliat Care,* 5(1):47-54 (Mar. 2011).
Meynell, "Antibacterial mechanisms of the mouse gut. II. The role of Eh and volatile fatty acids in the normal gut," *British journal of experimental pathology* 44: 209-219 (Aug. 1962).
Michielan, "Intestinal Permeability in Inflammatory Bowel Disease: Pathogenesis, Clinical Evaluation, and Therapy of Leaky Gut," *Mediators of Inflammation,* vol. 2015, Article ID 628157, 10 pages (Sep. 2015).
Montassier et al., "Pretreatment gut microbiome predicts chemotherapy-related bloodstream infection," *Genome Medicine,* 8:49, pp. 1-11 (2016).
Montassier, et al., "Chemotherapy-driven dysbiosis in the intestinal microbiome," *Alimentary Pharmacology & Therapeutics,* vol. 42, No. 5, pp. 515-528 (2015).
Okumura, et al., "Crosstalk between intestinal epithelial cells and commensal bacteria," *Leading Author's,* 5, e007, 13 pages, (2016).
Olsan et al., "Colonization resistance: the deconvolution of a complex trait," *Journal of Biological Chemistry,* 292(21): 8577-8581 (Apr. 2017).
Pamer, "Immune responses to commensal and environmental microbes," *Nature Immunology* 8(11):1173-1178 (Nov. 2007).
Papanicolas, et al., "Not Just Antibiotics: 15 Cancer Chemotherapy Driving Antimicrobial Resistance?" *Trends in Microbiology,* vol. 26, No. 5, pp. 393-400 (May 2018).
Petrof, er al., "From Stool Transplants to Next-Generation Microbiota Therapeutics," *Gastroenterology,* vol. 146, No. 6, pp. 1573-1582 (May 2014).
Pretorius et al., "Acute induction of anomalous and amyloidogenic blood clotting by molecular amplification of highly substoichiometric levels of bacterial lipopolysaccharide," *J R Soc Interface,* 13(122):20160539, 11 pages (Sep. 2016).
Rakoff-Nahoum et al., "Recognition of commensal microflora by toll-like receptors is required for intestinal homeostasis," *Cell* 118:229-241 (Jul. 2004).
Response to Office Action filed Feb. 25, 2014, in European Patent Application No. 11728077.6.
Response to Office Action filed Jan. 28, 2015, in European Patent Application No. 11728077.6.
Response to Office Action filed Nov. 18, 2015, in European Patent Application No. 11728077.6.
Rivera-Chavez et al., "Depletion of butyrate-producing Clostridia from the gut microbiota drives an aerobic luminal expansion of *Salmonella," Cell Host and Microbe* 19: 443-454 (Apr. 2016).
Schuijt et al., "The gut microbiota plays a protective role in the host defence against pneumococcal pneumonia," *Gut,* 65(4):575-583 (Apr. 2016).

(56) References Cited

OTHER PUBLICATIONS

Seki et al., "Role of innate immunity and the microbiota in liver fibrosis: crosstalk between the liver and gut," *J Physiol.* 1;590(Pt 3):447-458 (Feb. 2012).
Serino et al., "Metabolic adaptation to a high-fat diet is associated with a change in the gut microbiota," *Gut,* 61(4):543-553 (Apr. 2012).
Smith et al., "The microbial metabolites, short-chain fatty acids, regulate colonic Treg cell homeostasis," *Science* 341:569-573 (Jul. 2013).
Spees et al., "Streptomycin-induced inflammation enhances *Escherichia coli* gut colonization through nitrate respiration," *MBio* 4(4): e00430, 10 pages (2013).
Supplementary European Search Report dated Mar. 30, 2021, in European Patent Application No. 18 84 3863.
Suzuki et al., "Physiological concentrations of short-chain fatty acids immediately suppress colonic epithelial permeability," *British Journal of Nutrition,* 100:297-305 (2008).
Taur et al., "Intestinal Domination and the Risk of Bacteremia in Patients Undergoing Allogeneic Hematopoietic Stem Cell Transplantation," *Clinical Infectious Diseases,* 55(7):905-914 (2012).
Thuy et al., "Nonalcoholic fatty liver disease in humans is associated with increased plasma endotoxin and plasminogen activator inhibitor 1 concentrations and with fructose intake," *The Journal of Nutrition,* 138(8):1452-1455 (Aug. 2008).
Ubeda et al., "Intestinal Microbiota Containing *Barnesiella* Species Cures Vancomycin-Resistant Enterococcus faecium Colonization," *Infection and Immununity,* 81(3):965-973 (Mar. 2013).
Vaishnava et al., "Paneth cells directly sense gut commensals and maintain homeostasis at the intestinal host-microbial interface," *PNAS,* 105(52):20858-20863 (Dec. 2008).
Vaishnava et al., "The Antibacterial Lectin RegIIIγ Promotes the Spatial Segregation of Microbiota and Host in the Intestine," *Science,* 334(6053):255-258 (Oct. 2011).
Vora et al., "Beta-defensin-2 expression is regulated by TLR signaling in intestinal epithelial cells," *Journal of Immunology* 173:5398-5405 (2004).
Winter et al., "Host-derived nitrate boosts growth of *E. coli* in the inflamed gut," *Science* 339:708-711 (Feb. 2013).
Winter et al., "The dynamics of gut-associated microbial communities during inflammation," *EMBO Reports,* 14(4):319-327 (2013).
Wlodarska et al., "Antibiotic Treatment Alters the Colonic Mucus Layer and Predisposes the Host to Exacerbated Citrobacter rodentium-Induced Colitis," *Infection and Immunity,* 1;79(4):1536-1545 (Apr. 2011).
Wu et al., "Microbiota metabolite short-chain fatty acid acetate promotes intestinal IgA response to microbiota which is mediated by GPR43," *Mucosal Immunology,* 10(4): 946-956 (Jul. 2017).
Zhao et al., "Reduction in fecal microbiota diversity and short-chain fatty acid producers in Methicillin-resistant *Staphylococcus aureus* infected individuals as revealed by PacBio single molecule, real-time sequencing technology," *Eur J Clin Microbiol Infect Dis.,* 36:1463-1472 (Apr. 2017).

* cited by examiner

PERCENTAGE OF ALL OTUs
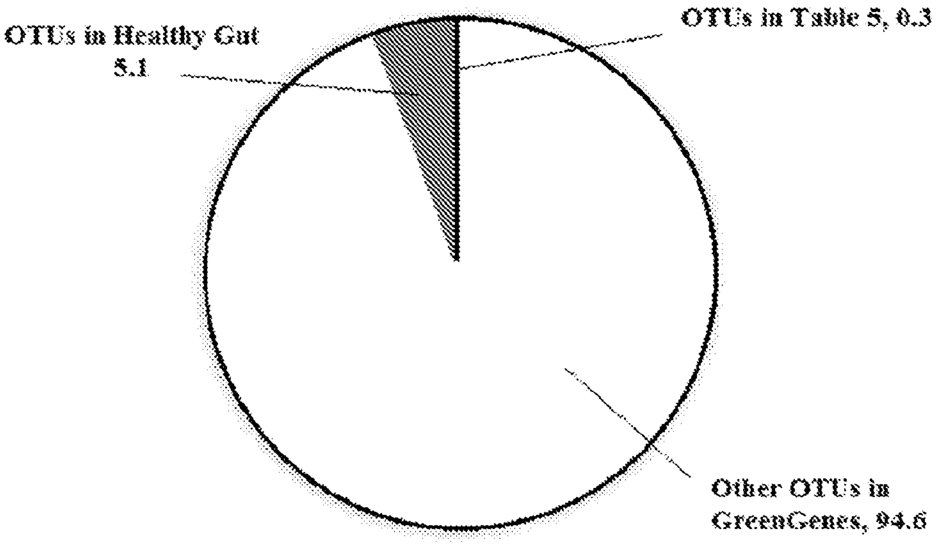

COMPOSITIONS AND METHODS FOR MAINTAINING AND RESTORING A HEALTHY GUT BARRIER

PRIORITY

This application is a U.S. National Stage Application under 37 U.S.C. § 371 of International Application No. PCT/US2018/045593, filed Aug. 7, 2018, which claims the benefit of and priority to US Provisional Application No. 62/542,035, filed Aug. 7, 2017, the contents of each of which are hereby incorporated by reference in their entirety.

FIELD OF THE INVENTION

The present invention relates to, in part, compositions and methods for the delivery of novel mixtures of bacterial strains useful for maintaining and restoring a healthy gut barrier.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: FIN-004-ST25.txt; date created: Feb. 5, 2020; file size: 1,918,132 bytes).

BACKGROUND

The human gastro-intestinal (GI) surface is approximately 400 $m^2$ in area, making it the largest barrier between the outside world and the human body. In fact, approximately 40% of the body's energy expenditure is used to maintain the gut barrier. Its function is to prevent loss of water and electrolytes from the body, allowing the exchange of small molecules and metabolites, and defending the body from commensal bacteria and their associated toxins and antigens.

Deficits in gut barrier function are associated with a number of diseases. Chronic conditions such as inflammatory bowel disease, irritable bowel syndrome, certain liver disorders, chronic inflammation (e.g., associated with hemodialysis), metabolic disease, cytotoxicity from chemotherapy (or other anti-cancer therapies) in cancer patients, hypercoagulation, and arthritis have been associated with a deficient gut barrier (i.e., a more permeable gut). More acute conditions such as infections, particularly bloodstream infections (BSI), have also been linked to disturbances in the gut barrier.

The human gut microbiome is known to play a role in maintaining the gut barrier. Commensal bacterial strains can induce thickening of the mucus layer. Short-Chain Fatty Acid (SCFA)-producing bacteria can secrete butyrate, which is a major energy source for the colonic epithelial cells. Other SCFAs, such as acetate, play a role in inducing the production of IgA. SCFA-producing bacteria may even compete with mucus-degrading bacteria to help maintain the gut barrier. Other bacteria produce molecules, like lipopolysaccharide and flagellin, which induce the production of antimicrobial peptides, such as RegIIIgamma which is a lectin with the ability to decolonize vancomycin-resistant *Enterococcus* (VRE).

For many inflammatory diseases, strong corticosteroids and other drugs with deleterious side effects are the only option for helping maintain and restoring a healthy gut barrier. Accordingly, there remains an unmet need for a microbiome-based therapeutic that helps maintain and restore a healthy gut barrier; this therapeutic treats chronic and acute conditions related to deficient gut barrier and with fewer side effects than currently-available therapies.

SUMMARY OF THE INVENTION

The present invention is based, in part, on the discovery that pharmaceutical compositions comprising certain mixtures of commensal bacterial strains can maintain the health of (i.e., properly maintain) and restore the integrity of the gut barrier. Thus, rather than treating the symptoms caused by a deficient gut barrier (i.e., a "leaky gut"), a microbiome-based therapeutic provides engraftment of commensal bacteria that restore and maintain a healthy gut barrier. This strategy can repair the source of a patient's symptoms that are related to a deficient gut barrier and generate a more durable cure, and with less cost and/or fewer deleterious side effects.

In various aspects, the present invention relates to a pharmaceutical composition comprising a bacterial mixture. The bacterial mixture includes at least one bacterial strain comprising a 16S rRNA sequence that is greater than about 97% identical (e.g., about 98%, 99%, 99.5%, and 100% identical) to the 16S rRNA sequence of any one of the operational taxonomic units (OTUs) recited in Table 5 and/or to the 16S rRNA sequence of any one OTU of a genus recited in Table 6.

In various embodiments, the bacterial mixture includes at least two bacterial strains (e.g., at least about five, ten, twenty, thirty, forty, fifty, and one-hundred bacterial strains), wherein a plurality of the bacterial strains comprises a 16S rRNA sequence that is greater than about 97% identical (e.g., about 98%, 99%, 99.5%, and 100% identical) to the 16S rRNA sequence of any one of the OTUs recited in Table 5 and/or to the 16S rRNA sequence of any one OTU of a genus recited in Table 6. In embodiments, the bacterial mixture includes at least two bacterial strains e.g., at least about five, ten, twenty, thirty, forty, fifty, and one-hundred bacterial strains), wherein each bacterial strain comprises a 16S rRNA sequence that is greater than about 97% identical (e.g., about 98%, 99%, 99.5%, and 100% identical) to the 16S rRNA sequence of one of the OTUs recited in Table 5 and/or to the 16S rRNA sequence of any one OTU of a genus recited in Table 6.

In various embodiments, the bacterial mixture includes between about five and one hundred bacterial strains (e.g., between about ten and about seventy-five, between about fifteen and about fifty, between about twenty and about forty-five, between about twenty-five and about forty bacterial, and between about thirty and about thirty-five bacterial strains), wherein a plurality of the bacterial strains comprises a 16S rRNA sequence that is greater than about 97% identical (e.g., about 98%, 99%, 99.5%, and 100% identical) to the 16S rRNA sequence of any one of the OTUs recited in Table 5 and/or to the 16S rRNA sequence of any one OTU of a genus recited in Table 6. In embodiments, the bacterial mixture includes between about five and about one hundred bacterial strains (e.g., between about ten and about seventy-five, between about fifteen and about fifty, between about twenty and about forty-five, between about twenty-five and about forty bacterial, and between about thirty and about thirty-five bacterial strains), wherein each bacterial strain comprises a 16S rRNA sequence that is greater than about 97% identical (e.g., about 98%, 99%, 99.5%, and 100% identical) to the 16S rRNA sequence of one of the OTUs recited in Table 5 and/or to the 16S rRNA sequence of any one OTU of a genus recited in Table 6.

In various embodiments, the bacterial mixture comprises a fecal microbiota preparation that comprises a donor's entire or substantially complete microbiota. In one aspect, a fecal microbiota preparation comprises a non-selected fecal microbiota. In another aspect, a fecal microbiota preparation comprises an isolated or purified population of live non-pathogenic fecal bacteria. In a further aspect, a fecal microbiota preparation comprises a non-selected and substantially complete fecal microbiota preparation from a single donor. In such embodiments, the bacterial mixture includes at least one bacterial strain comprising a 16S rRNA sequence that is greater than about 97% identical (e.g., about 98%, 99%, 99.5%, and 100% identical) to the 16S rRNA sequence of any one of the operational taxonomic units (OTUs) recited in Table 5 and/or to the 16S rRNA sequence of any one OTU of a genus recited in Table 6. In various embodiments, at least one bacterial strain in a bacterial mixture is a commensal bacterial strain.

In various embodiments, at least one bacterial strain in a bacterial mixture is obtained from one or more human beings, e.g., a human being who is healthy and/or satisfies at least one selection criterion.

In various embodiments, at least one bacterial strain in a bacterial mixture is obtained from a laboratory stock or bacterial cell bank.

In various embodiments, at least one bacterial strain in a bacterial mixture is isolated, cultured, and/or purified from its source material prior to forming the bacterial mixture. In various embodiments, at least one bacterial strain in a bacterial mixture is not isolated, cultured, and/or purified from its source material prior to forming the bacterial mixture.

In various embodiments, at least one bacterial strain is included in the bacterial mixture due to a greater (e.g., at least two-fold) amount of the bacterial strain in feces of a subject who did not develop a bloodstream infection (BSI), e.g., an Enterococcal BSI, compared to the amount of the bacterial strain in feces of a subject who developed an Enterococcal BSI.

In various embodiments, at least one bacterial strain is included in the bacterial mixture due to a greater (e.g., at least two-fold) amount of the bacterial strain in feces of a subject receiving chemotherapy who did not develop a bloodstream infection (BSI), e.g., an Enterococcal BSI, compared to the amount of the bacterial strain in feces of a subject receiving chemotherapy who developed an BSI.

In various embodiments, at least one bacterial strain is included in the bacterial mixture due to a greater (e.g., at least two-fold) amount of the bacterial strain in feces of a subject who did not develop a bloodstream infection (BSI) caused by a Gram negative bacteria compared to the amount of the bacterial strain in feces of a subject who developed an BSI caused by a Gram negative bacteria.

In various embodiments, at least one bacterial strain is included in the bacterial mixture due to its ability to help maintain and/or repair a deficient gut barrier, for example by directly inhibiting a pathogenic bacterium through production of a secreted product, by activating Toll-Like Receptors (TLRs), by inducing a thickening of the colonic epithelial mucus, by inducing an increase in IgA production, by inducing an increase in antimicrobial peptide production, by inducing improved tight junction integrity, by producing Short-Chain Fatty Acid (SCFAs), by enhancing production of SCFAs, by maintaining the health of colonocytes, by inducing IgA production, by increasing of butyrate levels in the gut, by inhibiting nitric oxide synthase activity, and/or by reducing the concentration of host-derived nitrate levels in the gut. In various embodiments, a plurality of bacterial strains are included in the bacterial mixture due to their ability to help maintain and/or repair a deficient gut barrier, for example by directly inhibiting a pathogenic bacterium through production of a secreted product, by activating Toll-Like Receptors (TLRs), by inducing a thickening of the colonic epithelial mucus, by inducing an increase in IgA production, by inducing an increase in antimicrobial peptide production, by inducing improved tight junction integrity, by producing Short-Chain Fatty Acid (SCFAs), by enhancing production of SCFAs, by maintaining the health of colonocytes, by inducing IgA production, by increasing of butyrate levels in the gut, by inhibiting nitric oxide synthase activity, and/or by reducing the concentration of host-derived nitrate levels in the gut. Activating TLRs can modulate production of antimicrobial peptides. In various embodiments, the pathogenic bacterium is an antibiotic-resistant bacterium (ARB).

In various embodiments, a pharmaceutical composition further includes a pharmaceutically acceptable excipient. In various embodiments, a pharmaceutical composition is formulated for oral administration and/or for delivery of the bacterial mixture to an intestine, e.g., the small intestine and/or the large intestine (e.g., including the cecum). In various embodiments, delivery of a pharmaceutical composition is substantially completed prior to the rectum. In various embodiments, a pharmaceutical composition is formulated as a capsule, e.g., a capsule including a delayed-release coating.

In various embodiments, a pharmaceutical composition includes a plurality of the bacterial strains that are live, vegetative cells, and/or lyophilized cells. A plurality of the bacterial strains in the bacterial mixture can be spores or spore-forming. In various embodiments, a plurality of the bacterial strains (e.g., all the bacterial strains) in the bacterial mixture can be non-pathogenic bacteria.

In various embodiments, a pharmaceutical composition is capable of maintaining and/or restoring a healthy gut barrier in a subject, e.g., a human subject.

In various embodiments, at least one bacterial strain in the bacterial mixture comprises a 16S rRNA sequence that is greater than about 97% identical to the 16S rRNA sequence of an OTU recited in Table 5 or Table 6 and from family Barnesiellaceae, at least one bacterial strain in the bacterial mixture comprises a 16S rRNA sequence that is greater than about 97% identical to the 16S rRNA sequence of an OTU recited in Table 5 or Table 6 and from family S24-7, at least one bacterial strain in the bacterial mixture comprises a 16S rRNA sequence that is greater than about 97% identical to the 16S rRNA sequence of an OTU recited in Table 5 or Table 6 and from family Mogibacteriaceae, at least one bacterial strain in the bacterial mixture comprises a 16S rRNA sequence that is greater than about 97% identical to the 16S rRNA sequence of an OTU recited in Table 5 or Table 6 and from family Christensenellaceae, at least one bacterial strain in the bacterial mixture comprises a 16S rRNA sequence that is greater than about 97% identical to the 16S rRNA sequence of an OTU recited in Table 5 or Table 6 and from family Lachnospiraceae, and/or at least one bacterial strain in the bacterial mixture comprises a 16S rRNA sequence that is greater than about 97% identical to the 16S rRNA sequence of an OTU recited in Table 5 or Table 6 and from family Ruminococcaceae. In various embodiments, at least one bacterial strain in the bacterial mixture comprises a 16S rRNA sequence that is greater than about 97% identical to the 16S rRNA sequence of an OTU recited in Table 5 or Table 6 and from family Barnesiellaceae, at least one bacterial strain in the bacterial mixture comprises a 16S rRNA sequence that is greater than about 97% identical to the 16S rRNA sequence of an OTU recited in Table 5 or Table 6 and from family S24-7, at least one bacterial strain in the bacterial mixture comprises a 16S rRNA sequence that is greater than about 97% identical to the 16S rRNA sequence of an OTU recited in Table 5 or Table 6 and from family Mogibacteriaceae, at least one bacterial strain in the bacterial mixture comprises a 16S rRNA sequence that is greater than about 97% identical to the 16S rRNA sequence of an OTU recited in Table 5 or Table 6 and from family Christensenellaceae, at least one bacterial strain in the bacterial mixture comprises a 16S rRNA sequence that is greater than about 97% identical to the 16S rRNA sequence of an OTU recited in Table 5 or Table 6 and from family Lachnospiraceae, and at least one bacterial strain in the bacterial mixture comprises a 16S rRNA sequence that is greater than about 97% identical to the 16S rRNA sequence of an OTU recited in Table 5 or Table 6 and from family Ruminococcaceae.

In various aspects, the present invention relates to a method for preventing one or more pathogenic bacteria from translocating across the gut barrier. The method includes administering to a subject (e.g., a human subject) in need thereof an effective amount of a pharmaceutical composition of any herein-disclosed aspect or embodiment.

In various embodiments, the one or more pathogenic bacteria has not yet translocated across the gut barrier and/or entered the bloodstream of the subject. In various embodiments, the one or more pathogenic bacteria has translocated across the gut barrier and/or entered the bloodstream of the subject. In various embodiments, administering an effective amount of the pharmaceutical composition prevents translocating and/or further translocating of the one or more pathogenic bacterial across the gut barrier and/or entering the bloodstream of the subject.

In various embodiments, the entering of the bloodstream by the one or more pathogenic bacteria can cause a disease selected from a bloodstream infection (BSI); a catheter or intravascular-line infection; a liver disorder; chronic inflammation, e.g., associated with hemodialysis; a chronic inflammatory disease; cytotoxicity from chemotherapy; hypercoagulation; an infection at locations remote from the gut; inflammatory bowel disease, e.g., Ulcerative colitis and Crohn's disease; irritable bowel syndrome; a metabolic disease, e.g., insulin resistance, including Type II diabetes; another well-known antibiotic-resistant infection; rheumatoid arthritis; a urinary tract infection (UTIs), e.g., antibiotic-resistant UTIs and catheter-associated urinary tract infections; and a wound infection.

In various embodiments, the one or more pathogenic bacteria includes one or more of *Aeromonas hydrophila, Bacillus*, e.g., *Bacillus cereus, Bifidobacterium, Bordetella, Borrelia, Brucella, Burkholderia, C. difficile, Campylobacter*, e.g., *Campylobacter fetus* and *Campylobacter jejuni, Chlamydia, Chlamydophila, Clostridium*, e.g., *Clostridium botulinum, Clostridium difficile*, and *Clostridium perfringens, Corynebacterium, Coxiella, Ehrlichia*, Enterobacteriaceae, e.g., Carbapenem-resistent Enterobacteriaceae (CRE) and Extended Spectrum Beta-Lactamase producing Enterobacteriaceae (ESBL-E), fluoroquinolone-resistant Enterobacteriaceae, *Enterococcus*, e.g., vancomycin-resistant *Enterococcus* spp., extended spectrum beta-lactam resistant Enterococci (ESBL), and vancomycin-resistant Enterococci (VRE), *Escherichia*, e.g., enteroaggregative *Escherichia coli*, enterohemorrhagic *Escherichia coli*, enteroinvasive *Escherichia coli*, enteropathogenic *E. coli*, enterotoxigenic *Escherichia coli* (such as but not limited to LT and/or ST), *Escherichia coli* 0157:H7, and multi-drug resistant bacteria *E. coli, Francisella, Haemophilus, Helicobacter*, e.g., *Helicobacter pylori, Klebsiella*, e.g., *Klebsiellia pneumonia* and multi-drug resistant bacteria *Klebsiella, Legionella, Leptospira, Listeria*, e.g., *Lysteria monocytogenes, Morganella, Mycobacterium, Mycoplasma, Neisseria, Orientia, Plesiomonas shigelloides*, Antibiotic-resistant Proteobacteria, *Proteus, Pseudomonas, Rickettsia, Salmonella*, e.g., *Salmonella paratyphi, Salmonella* spp., and *Salmonella typhi, Shigella*, e.g., *Shigella* spp., *Staphylococcus*, e.g., *Staphylococcus aureus* and *Staphylococcus* spp., *Streptococcus, Treponema, Vibrio*, e.g., *Vibrio cholerae, Vibrio parahaemolyticus, Vibrio* spp., and *Vibrio vulnificus*, and *Yersinia*, e.g., *Yersinia enterocolitica*. At least one of the one or more pathogenic bacteria can be an antibiotic-resistant bacterium (ARB), e.g., Antibiotic-resistant Proteobacteria, Vancomycin Resistant *Enterococcus* (VRE), Carbapenem Resistant Enterobacteriaceae (CRE), fluoroquinolone-resistant Enterobacteriaceae, or Extended Spectrum Beta-Lactamase producing Enterobacteriaceae (ESBL-E).

In various embodiments, a subject in need thereof has chronic kidney disease, cancer, and/or received an organ transplant.

In various embodiments, a subject in need thereof has received, is receiving, or will receive an anti-cancer therapeutic agent and/or an anti-cancer therapy. Thus, the pharmaceutical compositions find use in reducing, treating, or preventing a side effect of an anti-cancer therapeutic agent and/or a side effect of an anti-cancer therapy and/or in increasing efficacy of an anti-cancer therapeutic agent and/or anti-cancer therapy. The anti-cancer therapy may be surgery, radiation therapy, chemotherapy (including hormonal therapy) and/or targeted therapy (including an immunotherapy). In embodiments, the subject in need thereof is suffering from a side effect of the anti-cancer therapy caused by gut dysbiosis.

An aspect of the present invention provides methods for increasing efficacy of an anti-cancer therapeutic agent and/or anti-cancer therapy. The method comprises administering to a subject in need thereof an effective amount of a pharmaceutical composition comprising a bacterial mixture as disclosed herein. The pharmaceutical composition is administered before, after, and/or contemporaneously with the anti-cancer therapeutic agent and/or anti-cancer therapy.

The subject in need thereof can be in an outpatient setting, hospitalized, and/or in along-term care facility.

In various embodiments, a subject in need thereof has or is at risk for a bloodstream infection (BSI); a catheter or intravascular-line infection; a liver disorder; chronic inflammation, e.g., associated with hemodialysis; a chronic inflammatory disease; meningitis; pneumonia, e.g., ventilator-associated pneumonia; skin and soft tissue infections; surgical-site infections; cytotoxicity from chemotherapy; hypercoagulation; an infection at locations remote from the gut; inflammatory bowel disease, e.g., Ulcerative colitis and Crohn's disease; irritable bowel syndrome; a metabolic disease, e.g., insulin resistance, including Type II diabetes; another well-known antibiotic-resistant infection or other well-known antibiotic sensitive infection; rheumatoid arthritis; a urinary tract infection (UTIs), e.g., antibiotic-resistant UTIs and catheter-associated urinary tract infections; and a wound infection.

Any aspect or embodiment disclosed herein can be combined with any other aspect or embodiment as disclosed herein.

BRIEF DESCRIPTION OF THE FIGURES

FIG. 1 is a pie chart showing percentages of all operational taxonomic units (OTUs) in the GreenGenes database that are not found in the healthy human gut, that are found in a healthy human gut but not included in Table 5, and that are found in a healthy human gut and are included in Table 5.

DETAILED DESCRIPTION

The present invention is based, in part, on the discovery that pharmaceutical compositions comprising certain mixtures of commensal bacterial strains, including non-selected or substantially complete fecal microbiota preparations (e.g., from a single healthy donor), can maintain the health of (i.e., properly maintain) and restore the integrity of the gut barrier; these pharmaceutical compositions treat chronic and acute conditions related to deficient gut barrier and with fewer side effects than currently-available therapies. Moreover, the mixtures of commensal bacterial strains can increase efficacy of an anti-cancer therapy, e.g., by simulating an immune response against a cancer cell, and can decrease the severity of a side effect or eliminate the side effect of an anti-cancer therapy, e.g., by protecting, maintaining, and restoring the integrity of the gut barrier before, during, and/or after receiving the anti-cancer therapy. Thus, the mixtures of the present invention are also useful in cancer-related applications.

Mixtures of Bacterial Strains

The present invention relates to pharmaceutical compositions (formulated for targeted delivery to the colon) of mixtures of bacterial strains that are introduced into the gut to promote the proper maintenance of the gut barrier and restoration of a deficient gut barrier.

Without wishing to be bound by theory, the mixture of bacterial strains of the present invention acts to protect, maintain, and restore the gut barrier through one or more mechanisms. A first mechanism is production of Short-Chain Fatty Acid (SCFAs) which increase the thickness of the mucus layer, maintain the health of colonocytes, and induce IgA production. A second mechanism is through activation of Toll-Like Receptors (TLRs), which modulate the production of antimicrobial peptides, which target many human bacterial pathogens. In the second mechanism, various bacterial products stimulate the immune system through the TLR-MyD88 mediated pathway. Stimulation of this pathway results in the upregulation of antimicrobial proteins. Antimicrobial proteins and peptides (AMPs) (e.g., the defensins or cathelicidins) are an important part of the innate immune system and are expressed throughout the body. In the gut, they are produced by the intestinal epithelial cells and Paneth cells to defend against undesired bacterial species (both commensal and pathogenic). AMP produced may be induced by a wide variety of stimuli including but not limited to vitamin D, cytokines, and microbial products. These stimulatory microbial products can include but are not limited to lipopolysaccharide (LPS), peptidoglycan, and flagellin. For example, flagellin is a TLR5 agonist that induces the production of the C-type lectin, RegIIIgamma. RegIIIgamma has roles in killing Gram-positive pathogens, including vancomycin resistant *Enterococcus* (VRE). There is also evidence that anti-infective AMPs play a role in attenuating host inflammatory responses through downregulation of cytokine production. Induction of AMPs assists the host with a properly modulated immune response to pathogens that accelerates healing of the gut epithelia while eradicating the colonizing pathogen.

Additionally, the mixture of bacterial strains of the present invention acts to protect, maintain, and restore the gut barrier through inducing a thickening of the colonic epithelial mucus, an increase in IgA production, an increase in antimicrobial peptide production and/or improved tight junction integrity.

The present invention helps prevent thinning of the mucus layer and translocation of pathogens across the epithelial layer to the bloodstream, thus, preventing bloodstream infections (BSI) and infections at locations remote from the gut. A restored and more stable gut barrier also prevents entry of toxic metabolites and bacterial byproducts into the bloodstream, thereby decreasing a source of chronic inflammation.

The mixture of bacterial strains of the present invention can be delivered to patients in a variety of ways including orally (e.g., in a capsule), via ND/NG tube, or colonoscopically. The mixture can also be formulated in a multitude of formulations including pure and/or isolated cultures, both lyophilized bacteria and aqueous solutions, spores, and as part of a broader community or consortium of bacteria (e.g., a mixture of natural communities, including bacteria contained in a source material).

This invention is useful for at least the following patient populations: (1) Patient populations at high risk for development of BSI, including Solid organ transplant patients; Chronic kidney disease patients, e.g., on hemodialysis; and oncology patients; and (2) Patient populations with the following inflammatory disorders: Inflammatory bowel disease (Ulcerative colitis and Crohn's disease); Irritable bowel syndrome; Metabolic disease/Insulin resistance (Type II diabetes); and Rheumatoid arthritis.

The invention is also useful for patients who are in an outpatient setting, hospitalized, or in long-term care facilities.

In embodiments, the present mixtures of bacterial strains are substantially complete fecal microbiota preparations (e.g., from a single healthy donor). A substantially complete microbiota preparation generally comprises a full complement of functional microorganisms found in feces of one or more healthy humans.

In embodiments, a present mixture of bacterial strains comprises a full complement of functional microorganisms found in feces of one healthy human or in feces of more than one healthy human donor. In embodiments, a present mixture of bacterial strains comprises a full complement of functional microorganisms found in feces of one healthy human or in feces of more than one healthy human donor and further comprises at least one bacterial strain comprising a 16S rRNA sequence that is greater than about 97% identical (e.g., about 98%, 99%, 99.5%, and 100% identical) to the 16S rRNA sequence of any one of the operational taxonomic units (OTUs) recited in Table 5 and/or to the 16S rRNA sequence of any one OTU of a genus recited in Table 6. In other words, a bacterial mixture comprising at least one bacterial strain in the bacterial mixture which comprises a 16S rRNA sequence that is greater than about 97% identical to the 16S rRNA sequence of any one OTU recited in Table 5 or any one OTU of a genus recited in Table 6 could further include a full complement of functional microorganisms, as disclosed herein.

In embodiments, a present mixture of bacterial strains comprises "less than the full complement" of functional microorganisms found in feces of one healthy human or in feces of more than one healthy human donor; here, at least one functional microorganism has been omitted from the full complement. In embodiments, a present mixture of bacterial strains comprises less than the full complement of functional microorganisms found in feces of one healthy human or in feces of more than one healthy human donor and further comprises at least one bacterial strain comprising a 16S rRNA sequence that is greater than about 97% identical (e.g., about 98%, 99%, 99.5%, and 100% identical) to the 16S rRNA sequence of any one of the operational taxonomic units (OTUs) recited in Table 5 and/or to the 16S rRNA sequence of any one OTU of a genus recited in Table 6. In other words, a bacterial mixture comprising at least one bacterial strain in the bacterial mixture which comprises a 16S rRNA sequence that is greater than about 97% identical to the 16S rRNA sequence of any one OTU recited in Table 5 or any one OTU of a genus recited in Table 6 could further include less than the full complement of functional microorganisms, as disclosed herein.

In various embodiments, the bacterial strains of the invention comprise bacteria isolated or purified from one or more humans. In various embodiments, the present mixtures of bacterial strains are isolated or purified from one or more humans. For instance, the isolation or purification may be from feces of the one or more humans. Further, the isolation or purification may be from aspirates of the fluid in the GI tract or mucosal biopsies from a site in the GI tract.

In various embodiments, the bacterial strains of the invention are isolated or purified from its source material, i.e., separated from at least some of the components with which they were associated when initially produced (e.g., nature (from feces) or in an experimental setting (a laboratory stock) and/or produced, prepared, purified, and/or manufactured by man. Bacterial strains may be separated from at least about 10%, or about 20%, or about 30%, or about 40%, or about 50%, or about 60%, or about 70%, or about 80%, or about 90%, or more of the other components with which they were initially associated. In some embodiments, bacterial strains are more than about 80%, or about 85%, or about 90%, or about 91%, or about 92%, or about 93%, or about 94%, or about 95%, or about 96%, or about 97%, or about 98%, or about 99%, or more than about 99% pure.

In embodiments, bacterial strains for a bacterial mixture are directly obtained from human feces. In these embodiments, fecal matter is collected from one or more humans and processed ultimately until a formulation suitable for oral delivery and/or delivery into the GI tract is prepared.

In other embodiments, bacterial strains for a bacterial mixture are indirectly obtained from human feces and/or are obtained independent of human feces (e.g., from a bacterial cell bank or from a laboratory stock). When indirectly obtained, bacterial strains from human feces are cultured and the bacteria are expanded and then isolated and/or purified. The isolated/purified bacteria can be introduced into a bacterial mixture comprising bacterial strains directly obtained from human feces. Alternately, a plurality of isolated/purified bacteria can be combined into a defined bacterial mixture comprising only bacterial strains indirectly obtained from human feces or obtained independent of human feces.

In various embodiments, human feces are obtained from screened, qualified donors.

In embodiments, a qualified donor provides feces having a full complement of functional microorganisms found in feces of one or more healthy humans, as disclosed herein.

In embodiments, a qualified donor provides feces having at least one bacterial strain (e.g., a plurality of bacterial strains) comprising a 16S rRNA sequence that is greater than about 97% identical (e.g., about 98%, 99%, 99.5%, and 100% identical) to the 16S rRNA sequence of any one of the operational taxonomic units (OTUs) recited in Table 5 and/or to the 16S rRNA sequence of any one OTU of a genus recited in Table 6. Moreover, the qualified donor provides feces substantially lacks bacterial strains known to be associated with infectious diseases, as disclosed elsewhere herein.

In embodiments of the present invention, potential donors are screened via: (1) Initial Preliminary Screen. Prior to enrollment, potential donors (e.g., aged about 18 to about 50) undergo a preliminary screen comprising a subset of questions selected from a Donor Health Questionnaire (DHQ) to assess eligibility and/or (2) In-Person Donor Interview. If the potential donor passes the initial preliminary screen, he/she conducts in-person interview and clinical assessment with a healthcare professional. As part of this interview the potential donor completes informed consent and a donor affidavit attesting to provide true, accurate, and complete information. The DHQ, in-person interview, and clinical assessment determine the potential donor's eligibility as a donor.

The DHQ and clinical assessment identify relevant criteria which would preclude one from being a donor (e.g., temporarily and permanently). Three categories of criteria covered by a DHQ include: (1) Infectious risk factors, e.g., risk for factors for multi-drug resistance organisms (MDROs); high-risk sexual behaviors; social history, including illicit drug use; high-risk travel history (including a 12-month exclusion if a potential donor has traveled to a high-risk or very high-risk area, as defined by current International SOS (ISOS) guidelines); (2) potential microbiome-mediated conditions and general health status, e.g., gastrointestinal comorbidities; metabolic comorbidities; neurological comorbidities; psychiatric comorbidities; chronic pain syndromes; infectious diseases; autoimmune diseases; atopy, asthma and allergies (food and other); malignancy; surgeries/other medical history; current symptoms (including stool habits); medications including antimicrobial therapy; diet; and family history; and (3) pregnancy and breastfeeding status, for potential female donors. In embodiments, the clinical assessment includes, as examples, determination of vital signs including temperature, blood pressure, heart rate, respiratory rate, waist circumference, and body mass index (BMI).

In embodiments, the DHQ is analogous to that used by the Red Cross for screening potential blood donors (with fewer or additional questions, if desired).

Potential donors who are eligible to be donors based upon their DHQ, in-person interview results, and clinical assessment then undergo a series of serological, stool, and nasal swab screens/tests. Serological, stool, and nasal swab testing/screening are performed in conjunction with a diagnostic laboratory, e.g., a Clinical Laboratory Improvement Amendments (CLIA)-certified diagnostic laboratory.

Table 1 provides an overview of exemplary serological, stool, and nasal swab screens/tests conducted as part of the donor screening process of various embodiments. Screening/testing is performed under conditions well-known in the art, such as, by way of a non-limiting example: Hepatitis C may be detected by an immunoassay (IA), Shiga may be detected by enzyme immunoassay (EIA), and *Clostridium difficile* may be detected by real-time polymerase chain reaction (RT-PCR).

TABLE 1

Exemplary Serological, Stool, and Nasal Swab Screens/Tests

| | Pathogen | |
|---|---|---|
| Serological Testing | HIV ½ | |
| | Hepatitis A | |
| | Hepatitis B | |
| | Hepatitis C | |
| | *Treponema pallidum* | |
| | *Strongyloides* | |
| Stool Testing | Multi-Drug Resistant Organisms | VRE |
| | | CRE |
| | | FRE |
| | | ESBL |
| | *Salmonella* spp | |
| | *Shigella* spp | |
| | *Campylobacter* spp | |
| | *Vibrio* spp | |
| | Rotavirus A | |
| | *Cryptosporidium* spp | |
| | Shiga | |
| | *Giardia lamblia* | |
| | Adenovirus | |
| | Norovirus | |
| | *Clostridium difficile* (e.g., a producer of Toxin B) | |
| | *Cryptosporidium* spp | |
| | *Helicobacter pylori* | |
| | Ova and parasites | |
| | *Cyclospora* and *Isospora* | |
| | Microsporidia | |
| | Bristol Stool Type assessment | |
| Nasal Swab | Multi-Drug Resistant Organisms | VRE |
| | | CRE |
| | | FRE |
| | | MRSA |
| | | ESBL |

VRE = Vancomycin-resistant enterococci; CRE = carbapenem-resistant Enterobacteriaceae; ESBL = Extended-spectrum beta-lactamases; FRE = fluoroquinolone-resistant Enterobacteriaceae.

In some embodiments, a potential donor is excluded if he/she has a positive result in a test/screen for an infectious disease, e.g., caused by one of the pathogens listed in Table 1. In some embodiments, a potential donor who tests positive for HIV-1/2, Hepatitis B, or Hepatitis C is indefinitely excluded from donating.

In some embodiments, a potential donor who tests positive for Hepatitis A, *Treponema pallidum*, or *Strongyloides* is deferred from donating until eight weeks after a successful treatment has been completed, symptoms have resolved, and no recurrence of symptoms have occurred.

In some embodiments, a potential donor who tests positive for Adenovirus, *Campylobacter* spp, *Clostridium difficile* toxin B, *Cryptosporidium* spp, *Cyclospora* and *Isospora, Giardialamblia, Proteus, Morganella, Helicobacter pylori*, Microsporidia, Norovirus, Ova and parasites, *Salmonella* spp, *Shiga, Shigella* spp, or *Vibrio* spp, is immediately placed on hold and deferred for eight weeks from symptom resolution, completion of treatment, and no recurrence. Screened donors deferred for eight weeks from symptom resolution, completion of treatment, and no recurrence due to any of the above may undergo a full repeat screen to evaluate for inclusion.

In some embodiments, a potential donor who tests positive for rotavirus is placed immediately on donation hold and undergoes repeat confirmatory testing. If confirmed positive, these donors are ineligible for donation for eight weeks. Screened donors deferred for eight weeks due to rotavirus may undergo a full repeat screen to evaluate for inclusion.

In some embodiments, a potential donor who tests positive for a Multi-Drug Resistant Organism (MDROs), e.g., Vancomycin-resistant *Enterococcus* (VRE), Carbapenem-resistant enterobacteriaceae (CRE), fluoroquinolone-resistant Enterobacteriaceae (FRE), and Extended-spectrum beta-lactamase (ESBL) is immediately placed on hold and deferred for eight weeks after successful treatment/decolonization with no symptoms or recurrence. Screened donors deferred for eight weeks after successful treatment/decolonization with no symptoms or recurrence due to any of the above may undergo a full repeat screen to evaluate for inclusion.

In some embodiments, a potential donor who tests positive for Methicillin-resistant *Staphylococcus aureus* (MRSA) is immediately placed on hold and deferred for eight weeks after successful treatment/decolonization with no symptoms or recurrence. Screened donors deferred for eight weeks after successful treatment/decolonization with no symptoms or recurrence due to any of the above may undergo a full repeat screen to evaluate for inclusion.

In some embodiments, potential donors may submit samples for additional screening which may include assays for Liver Function Panel, Alanine Aminotransferase (ALT), Aspartate Aminotransferase (AST), Alkaline Phosphatase (ALP), Albumin, Bilirubin (Total, direct, or indirect), and Complete Blood Count (CBC) with Differential. Donors whose results from these Additional Screening assays are outside the bounds of normal (see, e.g., Table 2) are ineligible to donate stool.

TABLE 2

Exemplary Low and High limit for Complete Blood Count (CBC) and Hepatic Function Panel (HFP)

| Test | Category | Low | High | Units |
|---|---|---|---|---|
| CBC | WBC | 3.8 | 10.8 | $\times 10^3/\mu L$ |
| CBC | RBC | 4.20 | 5.80 | $\times 10^6/\mu L$ |
| CBC | Hemoglobin | 13.2 | 17.1 | g/dL |
| CBC | Hematocrit | 38.5 | 50.0 | % |
| CBC | MCV | 80 | 100 | fL |
| CBC | MCH | 27.0 | 33.0 | pg |
| CBC | MCHC | 32.0 | 36.0 | g/dL |
| CBC | RDW | 11 | 15 | % |
| CBC | Platelets | 140 | 400 | $\times 10^3/\mu L$ |
| CBC | MPV | 7.5 | 11.5 | fL |
| CBC | Absolute Neutrophils | 1500 | 7800 | cells/μL |
| CBC | Absolute Lymphocytes | 850 | 3900 | cells/μL |
| CBC | Absolute Monocytes | 200 | 950 | cells/μL |
| CBC | Absolute Eosinophils | 15 | 500 | cells/μL |
| CBC | Absolute Basophils | 0 | 200 | cells/μL |
| HFP | Protein, Total, Serum | 6.1 | 8.1 | g/dL |
| HFP | Albumin, Serum | 3.6 | 5.1 | g/dL |
| HFP | Bilirubin, Total | 0.2 | 1.2 | mg/dL |
| HFP | Bilirubin, Direct | 0.00 | 0.20 | mg/dL |
| HFP | Bilirubin, Indirect | 0.2 | 1.2 | mg/dL |
| HFP | Alkaline Phosphatase, Serum | 40 | 115 | U/L |
| HFP | AST (SGOT) | 10 | 40 | U/L |
| HFP | ALT (SGPT) | 9 | 46 | U/L |

If the cause of abnormal assay results is found to be either infectious or may otherwise compromise the health of the donor or an FMT recipient, that donor may be excluded from donating stool for clinical use. If the cause of the abnormal reading is determined to be not clinically significant and to pose no threat to an FMT recipient, as examples, the result is an incidental artifact or due to Gilbert's syndrome, then the donor may be considered for enrollment/re-enrollment.

Other screens or tests may also be used to exclude or include potential donors.

In some embodiments, a potential donor may be positive for one or both of Cytomegalovirus (CMV) and Epstein-Barr Virus (EBV). There have not been any reported cases of CMV or EBV infection among those who have received FMT from adult donors (Wang et al., 2016), including a large series of immunocompromised patients (Kelly et al., 2014) and solid organ transplant patients (Fischer et al., 2017).

In some embodiments, a potential donor may be positive for *Listeria monocytogenes*. In embodiments, donated material and/or serological samples are not tested for *L. monocytogenes* unless the donor is symptomatic for a *L. monocytogenes* infection.

In some embodiments, before or after a stool donation event, the pre-screened donor again completes a DHQ. A donor's eligibility will be further evaluated should he/she have any positive responses in this questionnaire. If the donor's responses indicate any changes in health status that involve an exclusion criterion, the donated material is discarded. When the donor's DHQ results do not indicate exclusion, the container and the stool material contained therein is processed.

In some embodiments, a donor may complete an in-person clinical health check around the time of a stool donation to ensure the donor's health. If the donor does not have good/optimal health, the donated material may be discarded.

In some embodiments, a donor is generally of good health and has microbiota consistent with such good health. Often, the donor has not been administered an antibiotic compound within a certain period prior to a stool donation.

In some embodiments, the donor does not have irritable bowel disease (e.g., Crohn's disease and ulcerative colitis), irritable bowel syndrome, celiac disease, colorectal cancer, or a family history of these diseases.

In some embodiments, a donor is selected for the presence of certain genera and/or species that provide increased efficacy of therapeutic compositions containing these genera or species. In some embodiments, a preferred donor donates stool material having a relatively high concentration of spores. In some embodiments, a preferred donor donates stool material comprising spores having increased efficacy.

In some embodiments, a sample of a donated stool material or a donated stool may be used for Additional Screening. Additional Screening may include assays for Liver Function Panel, Alanine Aminotransferase (ALT), Aspartate Aminotransferase (AST), Alkaline Phosphatase (ALP), Albumin, Bilirubin (Total, direct, indirect), and Complete Blood Count (CBC) with Differential. Donors whose results from these Additional Screening assays are outside the bounds of normal (see, e.g., Table 2) the donated material may be discarded.

Other screens or tests may also be used to temporarily or permanently exclude donors.

In some embodiments, a donor who tests positive for Hepatitis A, *Treponema pallidum*, or *Strongyloides* is deferred from donating until eight weeks after a successful treatment has been completed, symptoms have resolved, and no recurrence of symptoms have occurred. Impacted donated material will be destroyed. Screened donors deferred for eight weeks from symptom resolution, completion of treatment, and no recurrence due to any of the above may undergo a full repeat screen to evaluate his/her return as a donor.

In some embodiments, a donor who tests positive for Adenovirus, *Campylobacter* spp, *Clostridium difficile* toxin B, *Cryptosporidium* spp, *Cyclospora* and *Isospora, Giardia lamblia, Proteus, Morganella, Helicobacter pylori*, Microsporidia, Norovirus, Ova and parasites, *Salmonella* spp, *Shiga, Shigella* spp, or *Vibrio* spp, is immediately placed on hold and deferred for eight weeks from symptom resolution, completion of treatment, and no recurrence. Impacted donated material will be discarded. Screened donors deferred for eight weeks from symptom resolution, completion of treatment, and no recurrence due to any of the above may undergo a full repeat screen to evaluate his/her return as a donor.

In some embodiments, a donor who tests positive for rotavirus will be placed immediately on donation hold and have repeat confirmatory testing performed. If confirmed positive, these donors will have their donated material discarded and will be ineligible for donation for eight weeks. Screened donors deferred for eight weeks due to rotavirus may undergo a full repeat screen to evaluate his/her return as a donor.

A donor who tests positive for a Multi-Drug Resistant Organism (MDROs), e.g., Vancomycin-resistant *Enterococcus* (VRE), Carbapenem-resistant enterobacteriaceae (CRE), fluoroquinolone-resistant Enterobacteriaceae (FRE) and Extended-spectrum beta-lactamase (ESBL) is immediately placed on hold and deferred for eight weeks after successful treatment/decolonization with no symptoms or recurrence. Impacted donated material will be discarded. Screened donors deferred for eight weeks after successful treatment/decolonization with no symptoms or recurrence due to any of the above may undergo a full repeat screen to evaluate his/her return as a donor.

In some embodiments, a donor who tests positive for Methicillin-resistant *Staphylococcus aureus* (MRSA) is immediately placed on hold and deferred for eight weeks after successful treatment/decolonization with no symptoms or recurrence. Impacted donated material will be discarded. Screened donors deferred for eight weeks after successful treatment/decolonization with no symptoms or recurrence due to any of the above may undergo a full repeat screen to evaluate his/her return as a donor.

In some embodiments, a donor may be positive for one or both of Cytomegalovirus (CMV) and Epstein-Barr Virus (EBV). There have not been any reported cases of CMV or EBV infection among those who have received FMT from adult donors (Wang et al., 2016), including a large series of immunocompromised patients (Kelly et al., 2014) and solid organ transplant patients (Fischer et al., 2017).

In some embodiments, a donor undergoes a blood test about twenty-one days, e.g., two weeks to a month, or longer, after his/her last donation to account for HIV seroconversion.

In some embodiments, a donor may be positive for *Listeria monocytogenes*. In embodiments, donated material and/or serological samples are not tested for *L. monocytogenes* unless the donor is symptomatic for a *L. monocytogenes* infection.

In embodiments, processing of a donated material begins within six hours of passage of stool material. Elapsed time prior to stool processing may be noted.

In some embodiments, donated material will be assessed using the Bristol stool scale and/or for hematochezia, melena, mucus, and/or steatorrhea. Collection of samples from the donated material may occur within the biosafety cabinet.

Stool below Bristol Type 3 and stool above Bristol Type 5 is discarded.

Stool exhibiting signs of hematochezia, melena, mucus, and/or steatorrhea is discarded.

In some embodiments, donated material is quarantined (i.e., not included in a drug substance and/or not included in a drug product) for a "collection window" of about sixty days, e.g., thirty to ninety days, and until the donor has passed a second DHQ, a second in-person clinical assessment, and/or a second set of serological, stool, and/or nasal swab tests (as described above). See, Table 3.

TABLE 3

| Donor Screening/Testing | | | |
|---|---|---|---|
| | | Testing Time Points | |
| Parameter | Acceptance Criteria | Start of collection window | End of collection window |
| Questionnaire & Interview | Pass | x | x |
| Serological | Negative for a panel of Infectious Diseases | x | x |
| Stool | Negative for a panel of Viruses, Enteric Pathogens, Parasites, etc. | x | x |
| MDRO | Negative for a panel of Multi-Drug Resistant Organisms | x | x |
| Additional Screening | "Normal" for a Liver Function panel and Complete Blood Count & Differential [b] | x | x |
| Donor Health Questionnaire (DHQ) completed at Delivery [a] | No issues noted that involve Exclusion Criteria | x | x |

[a] In addition to the DHQ, if a donor experiences any abnormal symptoms, including a change in bowel habits or change in other relevant clinical factors (e.g., medicines and medical history) donors should notify to the donation facility immediately. A full health assessment is conducted and if symptoms would lead to stool that may impact the health of an FMT recipient, donation is suspended until an examination of the underlying symptoms is initiated by clinical assessment and/or diagnostic tests on stool and/or blood. The impacted material may be discarded. In the event of transient, self-limiting, mild symptoms, donors may be eligible when symptoms resolve.
[b] See, Table 2

TABLE 4

| Physical Testing Conducted on Donated Material | | |
|---|---|---|
| Parameter | Acceptance Criteria | Justification |
| Bristol Stool Type | Bristol Stool Type must be Type 3, 4, or 5 | Bristol Stool Type of 2, 3, 4, and 5 are considered healthy. Types above that range (i.e. Type 6 and 7) indicate diarrhea; these Stool Types are not processed. Stool with a Bristol Stool Type 1 or 2, which indicates constipation, may be too rigid or dense for readily processing; these Stool Types are not processed. |
| Screening of Stool for Hematochezia | Hematochezia Visually Absent | The presence of fresh blood in stool indicates lower gastrointestinal pathology (e.g., diverticulosis and inflammatory bowel disease) or, less commonly, a brisk upper gastrointestinal bleed. Stool with hematochezia is not processed. |
| Screening of Stool for Melena | Melena Visually Absent | The presence of melena in stool indicates upper gastrointestinal bleeding (e.g., peptic ulcer disease, gastritis, and esophageal varices). Stool with melena is not processed. |
| Screening of Stool for Mucus | Mucus Visually Absent | Although small amounts of mucus are normal, the presence of mucus in stool potentially indicates gastrointestinal pathology (e.g., inflammatory bowel disease and malignancy). Stool with mucus is processed. |
| Screening of Stool for Steatorrhea | Steatorrhea Visually Absent | The presence of steatorrhea in stool indicates fat malabsorption (e.g., pancreatic insufficiency). Stool with steatorrhea is not processed. |

In some embodiments, the viability of the microbiota of the donated stool may be confirmed by culturing a sample of the donated stool, an otherwise purified form of the donated stool, a filtrate, a homogenized product, a thawed-frozen intermediate, a pooled material, and/or a drug substance. Methods for culturing microbiota from stool or from stool-derived products are well-known in the art. In some embodiments, microbiota are cultured using the Center for Disease Control (CDC) plate, commonly referred to as "CDC Anaerobe 5% Sheep Blood Agar plate, which allows for the isolation and cultivation of fastidious and slow-growing obligatory anaerobic bacteria, the Bacteroides Bile Esculin Agar (BBE) plate, which is a specific indicator species media for Bacteroides, or GIFU Anaerobic Medium Agar (GAA). In some embodiments, the number of viable, culturable cells within the stool or stool-derived products may be confirmed by the presence of a colony forming unit (CFU) counts, e.g., by the Drop Plate CFU Assay. The diversity of the living microbes in the stool or from stool-derived products may be assayed. The mix of microbes present, or diversity of microbes, is a further measure of the quality of the donated stool and the drug substance.

In some embodiments, the viability of the microbiota of the donated stool may be confirmed by PMAseq; Chu et al., "Using Propodium Monoazide Sequencing (PMA-Seq) to Develop Data-Driven Best Practices in Fecal Microbiota Transplantations." *Open Forum Infect Dis.* Oxford University Press; 2015)]. Briefly, this approach provides a high-throughput, culture-independent measure of cell viability.

In some embodiments, the bacteria are live, vegetative cells. In some embodiments, the bacteria are capable of forming spores. In some embodiments, the bacteria are in the form of spores, e.g., viable spores. In some embodiments, the mixtures of bacterial strains as described herein comprise live, vegetative cells and spores. In some embodiments, the mixture of bacterial strains as described herein is substantially free of live, vegetative cells. In some embodiments, the mixture of bacterial strains as described herein is substantially free of spores. In some embodiments, the bacterial strains are in the form of live, vegetative cells. In some embodiments, the bacterial strains are in the form of spores. In some embodiments, the bacterial strains are in the form of lyophilized cells. In some embodiments, the bacterial mixture comprises one or more of live, vegetative cells; spores; and lyophilized cells.

In some embodiments, the bacterial strains are non-pathogenic. For instance, in some embodiments, the bacterial strains are substantially free of organisms or entities which are capable of causing or affecting a disease, disorder or condition of a host organism containing the organism or entity. Illustrative pathogenic bacteria are provided elsewhere herein.

In various embodiments, the mixture of bacterial strains includes one or more non-pathogenic bacterial strains that are able to engraft in a patient's GI tract. In some embodiments, the mixture of bacterial strains includes one or more non-pathogenic bacterial strains that are able to colonize a patient's mucosal barrier. In some embodiments, the mixture of bacterial strains includes one or more bacterial strains that preserve and/or enhance mucosal barrier integrity and function in a patient. In various embodiments, the mixture of bacterial strains includes one or more bacterial strains that can help maintain and/or repair a deficient gut barrier. In some embodiments, the mixture of bacterial strains includes one or more bacterial strains that produce Short-Chain Fatty Acid (SCFAs) which increase the thickness of the mucus layer, maintain the health of colonocytes, and induce IgA production. In various embodiments, the mixture of bacterial strains includes one or more bacterial strains that activate Toll-Like Receptors (TLRs), which modulate the production of antimicrobial peptides, which target many human bacterial pathogens. In another embodiment, the mixture of bacterial strains includes one or more bacterial strains that enhance production of one or more of butyrate, acetate, and propionate. In various embodiments, the mixture of bacterial strains induces proliferation and/or accumulation of $Foxp3^+$ cells, e.g., regulatory T cells ($T_{regs}$). In various embodiments, the mixture of bacterial strains induces proliferation and/or accumulation of interleukin-10 (IL-10). In various embodiments, the mixture of bacterial strains reduces proliferation and/or accumulation interleukin-12 (IL-12), interleukin-4 (IL-4), and/or and gamma interferon (IFN γ).

Without wishing to be bound by theory, treatment of the gut microbiome with antibiotics can result in a reduction of butyrate levels in the gut. Butyrate serves as the primary energy source of colonocytes and with decreased butyrate levels, colonocytes switch to anaerobic/fermentative growth. Because this growth does not utilize oxygen, the gut barrier becomes increasingly oxygenated. Butyrate also normally inhibits nitric oxide synthase, so in the absence of normal butyrate levels, the concentration of host-derived nitrate in the gut increases. Enterobacteriaceae are often opportunistic pathogens, and blooms of these bacteria are a sign of dysbiosis and inflammation. Members of Enterobacteriaceae can use both nitrate and oxygen as electron acceptors during respiration. Therefore, antibiotic treatment can result in decreased butyrate production, leading to increased oxygen and nitrate content in the gut, which gives potentially pathogenic facultative anaerobes like Enterobacteriaceae a growth advantage, resulting in an Enterobacteriaceae bloom.

In various embodiments, the present mixture of bacterial strains provides both systemic anti-inflammatory and immunoregulatory effects.

In various embodiments, the present mixture of bacterial strains includes one or more isolated or purified bacterial strains that individually or when together in a mixture have a cytotoxic or cytostatic effect on a pathogenic bacterium, as described elsewhere herein. In various embodiments, the present mixture of bacterial strains exerts an inhibitory effect on a pathogenic bacterium present in or entering into the GI tract of a patient. In various embodiments, the present mixture of bacterial strains augments growth of at least one type of bacteria not detectably present in a patient's GI tract prior to administration. In various embodiments, the present mixture of bacterial strains includes one or more isolated or purified bacterial strains that interact synergistically to have a cytotoxic or cytostatic effect on a pathogenic bacterium.

Illustrative pathogenic bacteria include *C. difficile, Salmonella* spp., enteropathogenic *E. coli*, multi-drug resistant bacteria such as *Klebsiella*, and *E. coli*, Carbapenem-resistent Enterobacteriaceae (CRE), fluoroquinolone-resistant Enterobacteriaceae, extended spectrum beta-lactam resistant Enterococci (ESBL), and vancomycin-resistant Enterococci (VRE). Further illustrative bacteria include *Yersinia, Vibrio, Treponema, Streptococcus, Staphylococcus, Shigella, Salmonella, Rickettsia, Orientia, Pseudomonas, Neisseria, Mycoplasma, Mycobacterium, Listeria, Leptospira, Legionella, Klebsiella, Helicobacter, Haemophilus, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium, Bacillus, Proteus, Morganella*, multi-drug resistant bacteria, extended spectrum beta-lactam resistant Enterococci (ESBL), Carbapenem-resistent Enterobacteriaceae (CRE), fluoroquinolone-resistant Enterobacteriaceae, and vancomycin-resistant Enterococci (VRE). Illustrative pathogenic bacteria include *Aeromonas hydrophila, Campylobacter fetus, Plesiomonas shigelloides, Bacillus cereus, Campylobacter jejuni, Clostridium botulinum, Clostridium difficile, Clostridium perfringens*, enteroaggregative *Escherichia coli*, enterohemorrhagic *Escherichia coli*, enteroinvasive *Escherichia coli*, enterotoxigenic *Escherichia coli* (such as, but not limited to, LT and/or ST), *Escherichia coli* 0157:H7, *Helicobacter pylori, Klebsiellia pneumonia, Lysteria monocytogenes, Plesiomonas shigelloides, Salmonella* spp., *Salmonella typhi, Salmonella paratyphi, Shigella* spp., *Staphylococcus* spp., *Staphylococcus aureus*, vancomycin-resistant *Enterococcus* spp., *Vibrio* spp., *Vibrio cholerae, Vibrio parahaemolyticus, Vibrio vulnificus*, and *Yersinia enterocolitica*. Specifically-relevant pathogenic bacteria include Antibiotic-resistant Proteobacteria, Vancomycin Resistant *Enterococcus* (VRE), Carbapenem Resistant Enterobacteriaceae (CRE), fluoroquinolone-resistant Enterobacteriaceae, and Extended Spectrum Beta-Lactamase producing Enterobacteriaceae (ESBL-E).

In various embodiments, a bacterial strain is included in the pharmaceutical composition of the invention based upon its 16S rRNA sequence identity. In an embodiment, the pharmaceutical composition of the invention comprises one or more bacterial strains having a 16S rRNA sequence that is at least about 80% identical to the 16S rRNA sequence of any one of the operational taxonomic units (OTUs) provided in Table 5 or Table 6. For example, the pharmaceutical composition may comprise one or more bacterial strains having a 16S rRNA sequence that is at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical with the 16S rRNA sequence of any one of the operational taxonomic units provided in Table 5 or Table 6. In an embodiment, the pharmaceutical composition may comprise one or more bacterial strains having a 16S rRNA sequence that is at least about 97%, at least about 98%, at least about 99%, or about 100% identical with the 16S rRNA sequence of any one of the operational taxonomic units provided in Table 5 or Table 6.

In various embodiments, the pharmaceutical composition of the invention comprises a bacterial mixture of at least about 50 different bacterial strains, or at least about 49 different bacterial strains, or at least about 48 different bacterial strains, or at least about 47 different bacterial strains, or at least about 46 different bacterial strains, or at least about 45 different bacterial strains, or at least about 44 different bacterial strains, or at least about 43 different bacterial strains, or at least about 42 different bacterial strains, or at least about 41 different bacterial strains, or at least about 40 different bacterial strains, or at least about 39 bacterial strains, or at least about 38 bacterial strains, or at least about 37 bacterial strains, or at least about 36 bacterial strains, or at least about 35 bacterial strains, or at least about 34 bacterial strains, or at least about 33 bacterial strains, or at least about 32 bacterial strains, or at least about 31 bacterial strains, or at least about 30 bacterial strains, or at least about 29 bacterial strains, or at least about 28 bacterial strains, or at least about 27 bacterial strains, or at least about 26 bacterial strains, or at least about 25 bacterial strains, or at least about 24 bacterial strains, or at least about 23 bacterial strains, or at least about 22 bacterial strains, or at least about 21 bacterial strains, or at least about 20 bacterial strains, or at least about 19 bacterial strains, or at least about 18 bacterial strains, or at least about 17 bacterial strains, or at least about 16 bacterial strains, or at least about 15 bacterial strains, or at least about 14 bacterial strains, or at least about 13 bacterial strains, or at least about 12 bacterial strains, or at least about 11 bacterial strains, or at least about 10 bacterial strains, or at least about 9 bacterial strains, or at least about 8 bacterial strains, or at least about 7 bacterial strains, or at least about 6 bacterial strains, or at least about 5 bacterial strains, or at least about 4 bacterial strains, or at least about 3 bacterial strains, or at least about 2 bacterial strains, or about 1 bacterial strain with reference to Table 5 or Table 6, e.g., as listed in Table 5 or Table 6 or having a 16S rRNA sequence that is, as examples, at least about 95%, at least about 96%, at least about 97%, at least about 98%, at least about 99%, or about 100% identical with the 16S rRNA sequence of any one of the strains listed in Table 5 or Table 6.

In various embodiments, the pharmaceutical composition of the invention comprises a bacterial mixture of about 50 or fewer different bacterial strains as described herein (e.g., with reference to Table 5 or Table 6).

In some embodiments, the pharmaceutical composition of the invention comprises greater than about 2, greater than about 5, or greater than about 10, or greater than about 15, or greater than about 20, or greater than about 25, or greater than about 30, or greater than about 35, or greater than about 40, or greater than about 45, or greater than about 50, greater than about 75, or greater than about 100 different bacterial strains as described herein (e.g., with reference to Table 5 or Table 6).

In some embodiments, the pharmaceutical composition of the invention comprises less than about 5, or less than about 10, or less than about 15, or less than about 20, or less than about 25, or less than about 30, or less than about 35, or less than about 40, or less than about 45, or less than about 50 different bacterial strains as described herein (e.g., with reference to Table 5 or Table 6).

In some embodiments, the pharmaceutical composition of the invention comprises about 10 to about 50 different bacterial strains as described herein (e.g., with reference to Table 5 or Table 6), including about 10 to about 45, or about 10 to about 40, or about 10 to about 30, or about 10 to about 20, or about 10 to about 15 different bacterial strains.

In some embodiments, the pharmaceutical composition of the invention comprises about 10 to about 20 different bacterial strains as described herein (e.g., with reference to Table 5 or Table 6).

In various embodiments, the mixtures of bacterial strains are selected from any of the bacterial strains listed in Table 5 or Table 6 below or the bacterial strains having a 16S rRNA sequence that is, as examples, at least about 95%, at least about 96%, at least about 97%, at least about 98%, at least about 99%, or about 100% identical with the 16S rRNA sequence of any one of the strains listed in Table 5 or Table 6 below.

In embodiments, the mixtures of bacterial strains are substantially complete fecal microbiota preparations, which generally comprises a full complement of functional microorganisms found in feces of one or more healthy humans (e.g., a single healthy stool donor). Such mixtures of bacterial strains may further comprise one or more strains listed in Table 5 or Table 6 below and/or one or more strains having a 16S rRNA sequence that is at least about 95% identical with the 16S rRNA sequence of any one of the strains listed in Table 5 or Table 6 below.

In embodiments, the pharmaceutical composition of the invention comprises at least one bacterial strain having a 16S rRNA sequence that is, as examples, at least about 95%, at least about 96%, at least about 97%, at least about 98%, at least about 99%, or about 100% identical with the 16S rRNA sequence of any one of the strains listed in Table 5 or Table 6 and which is from the family Barnesiellaceae.

In embodiments, the pharmaceutical composition of the invention comprises at least one bacterial strain having a 16S rRNA sequence that is, as examples, at least about 95%, at least about 96%, at least about 97%, at least about 98%, at least about 99%, or about 100% identical with the 16S rRNA sequence of any one of the strains listed in Table 5 or Table 6 and which is from the family S24-7.

In embodiments, the pharmaceutical composition of the invention comprises at least one bacterial strain having a 16S rRNA sequence that is, as examples, at least about 95%, at least about 96%, at least about 97%, at least about 98%, at least about 99%, or about 100% identical with the 16S rRNA sequence of any one of the strains listed in Table 5 or Table 6 and which is from the family Mogibacteriaceae.

In embodiments, the pharmaceutical composition of the invention comprises at least one bacterial strain having a 16S rRNA sequence that is, as examples, at least about 95%, at least about 96%, at least about 97%, at least about 98%, at least about 99%, or about 100% identical with the 16S rRNA sequence of any one of the strains listed in Table 5 or Table 6 and which is from the family Christensenellaceae.

In embodiments, the pharmaceutical composition of the invention comprises at least one bacterial strain having a 16S rRNA sequence that is, as examples, at least about 95%, at least about 96%, at least about 97%, at least about 98%, at least about 99%, or about 100% identical with the 16S rRNA sequence of any one of the strains listed in Table 5 or Table 6 and which is from the family Lachnospiraceae.

In embodiments, the pharmaceutical composition of the invention comprises a plurality of bacterial strains wherein a strain that has a 95% identical with the 16S rRNA sequence of any one of the strains listed in Table 5 or Table 6 and which is from the family Barnesiellaceae, a strain that has a 95% identical with the 16S rRNA sequence of any one of the strains listed in Table 5 or Table 6 and which is from the family S24-7, a strain that has a 95% identical with the 16S rRNA sequence of any one of the strains listed in Table 5 or Table 6 and which is from the family Mogibacteriaceae, a strain that has a 95% identical with the 16S rRNA sequence of any one of the strains listed in Table 5 or Table 6 and which is from the family Christensenellaceae, a strain that has a 95% identical with the 16S rRNA sequence of any one of the strains listed in Table 5 or Table 6 and which is from the family Lachnospiraceae, and/or a strain that has a 95% identical with the 16S rRNA sequence of any one of the strains listed in Table 5 or Table 6 and which is from the family Ruminococcaceae; a pharmaceutical composition may have two, three, four, or five of the aforementioned strains. In embodiments, the pharmaceutical composition of the invention comprises a plurality of bacterial strains wherein a strain that has a 95% identical with the 16S rRNA sequence of any one of the strains listed in Table 5 or Table 6 and which is from the family Barnesiellaceae, a strain that has a 95% identical with the 16S rRNA sequence of any one of the strains listed in Table 5 or Table 6 and which is from the family S24-7, a strain that has a 95% identical with the 16S rRNA sequence of any one of the strains listed in Table or Table 6 and which is from the family Mogibacteriaceae, a strain that has a 95% identical with the 16S rRNA sequence of any one of the strains listed in Table 5 or Table 6 and which is from the family Christensenellaceae, a strain that has a 95% identical with the 16S rRNA sequence of any one of the strains listed in Table 5 or Table 6 and which is from the family Lachnospiraceae and a strain that has a 95% identical with the 16S rRNA sequence of any one of the strains listed in Table 5 or Table 6 and which is from the family Ruminococcaceae; thus, the pharmaceutical composition has each of the six strains.

Table 5 lists OTUs by their GreenGenes identification number and the Latin taxonomic name associated with each OTU.

Columns:

- A—GreenGenes ID for OTU
- B—The number of stool donors that OTU is present in
- C—The fraction of all stool donors that OTU is present in
- D—Taxonomy for the OTU
- E—SEQ ID NO of the 16S rRNA sequence for the OTU

TABLE 5

Exemplary OTUs Useful in the Present Invention

| A[1] | B | C | D[2] | E |
|---|---|---|---|---|
| 12574 | 17 | 0.26984127 | k: Bacteria; p: Actinobacteria; c: Actinobacteria; o: Actinomycetales; f: Actinomycetaceae; g: *Actinomyces*; s: | 1 |
| 14157 | 1 | 0.015873016 | k: Bacteria; p: Firmicutes; c: Clostridia; o: Clostridiales; f: [Mogibacteriaceae]; g: ; s: | 2 |
| 14159 | 3 | 0.047619048 | k: Bacteria; p: Firmicutes; c: Clostridia; o: Clostridiales; f: [Mogibacteriaceae]; g: ; s: | 3 |
| 17311 | 9 | 0.142857143 | k: Bacteria; p: Firmicutes; c: Clostridia; o: Clostridiales; f: Christensenellaceae; g: ; s: | 4 |
| 27326 | 1 | 0.015873016 | k: Bacteria; p: Firmicutes; c: Clostridia; o: Clostridiales; f: Veillonellaceae; g: ; s: | 5 |
| 34789 | 1 | 0.015873016 | k: Bacteria; p: Firmicutes; c: Clostridia; o: Clostridiales; f: Christensenellaceae; g: ; s: | 6 |
| 35260 | 3 | 0.047619048 | k: Bacteria; p: Firmicutes; c: Clostridia; o: Clostridiales; f: Christensenellaceae; g: ; s: | 7 |
| 36792 | 1 | 0.015873016 | k: Bacteria; p: Firmicutes; c: Clostridia; o: Clostridiales; f: [Mogibacteriaceae]; g: ; s: | 8 |
| 41229 | 2 | 0.031746032 | k: Bacteria; p: Proteobacteria; c: Betaproteobacteria; o: Burkholderiales; f: Alcaligenaceae; g: *Sutterella*; s: | 9 |
| 68841 | 10 | 0.158730159 | k: Bacteria; p: Firmicutes; c: Clostridia; o: Clostridiales; f: Lachnospiraceae; g: *Lachnospira*; s: | 10 |
| 91359 | 1 | 0.015873016 | k: Bacteria; p: Firmicutes; c: Clostridia; o: Clostridiales; f: Lachnospiraceae; g: *Lachnospira*; s: | 11 |
| 92123 | 1 | 0.015873016 | k: Bacteria; p: Actinobacteria; c: Actinobacteria; o: Actinomycetales; f: Actinomycetaceae; g: *Actinomyces*; s: | 12 |
| 92262 | 1 | 0.015873016 | k: Bacteria; p: Actinobacteria; c: Actinobacteria; o: Actinomycetales; f: Actinomycetaceae; g: ; s: | 13 |
| 92874 | 2 | 0.031746032 | k: Bacteria; p: Actinobacteria; c: Actinobacteria; o: Actinomycetales; f: Actinomycetaceae; g: *Actinomyces*; s: | 14 |
| 110458 | 2 | 0.031746032 | k: Bacteria; p: Firmicutes; c: Clostridia; o: Clostridiales; f: Christensenellaceae; g: ; s: | 15 |
| 112891 | 2 | 0.031746032 | k: Bacteria; p: Proteobacteria; c: Betaproteobacteria; o: Burkholderiales; f: Alcaligenaceae; g: *Sutterella*; s: | 16 |
| 113417 | 5 | 0.079365079 | k: Bacteria; p: Proteobacteria; c: Deltaproteobacteria; o: Desulfovibrionales; f: Desulfovibrionaceae; g: ; s: | 17 |
| 122656 | 7 | 0.111111111 | k: Bacteria; p: Firmicutes; c: Clostridia; o: Clostridiales; f: Christensenellaceae; g: ; s: | 18 |
| 132784 | 1 | 0.015873016 | k: Bacteria; p: Firmicutes; c: Clostridia; o: Clostridiales; f: Veillonellaceae; g: *Phascolarctobacterium*; s: | 19 |

TABLE 5-continued

| Exemplary OTUs Useful in the Present Invention | | | | |
|---|---|---|---|---|
| A[1] | B | C | D[2] | E |
| 145236 | 5 | 0.079365079 | k: Bacteria; p: Firmicutes; c: Clostridia; o: Clostridiales; f: Christensenellaceae; g: ; s: | 20 |
| 145856 | 7 | 0.111111111 | k: Bacteria; p: Firmicutes; c: Clostridia; o: Clostridiales; f: [Mogibacteriaceae]; g: ; s: | 21 |
| 145887 | 1 | 0.015873016 | k: Bacteria; p: Firmicutes; c: Clostridia; o: Clostridiales; f: [Mogibacteriaceae]; g: ; s: | 22 |
| 147071 | 54 | 0.857142857 | k: Bacteria; p: Actinobacteria; c: Coriobacteriia; o: Coriobacteriales; f: Coriobacteriaceae; g: *Collinsella*; s: | 23 |
| 147484 | 7 | 0.111111111 | k: Bacteria; p: Firmicutes; c: Clostridia; o: Clostridiales; f: [Mogibacteriaceae]; g: ; s: | 24 |
| 158113 | 3 | 0.047619048 | k: Bacteria; p: Proteobacteria; c: Betaproteobacteria; o: Burkholderiales; f: Alcaligenaceae; g: *Sutterella*; s: | 25 |
| 164259 | 1 | 0.015873016 | k: Bacteria; p: Firmicutes; c: Clostridia; o: Clostridiales; f: Veillonellaceae; g: ; s: | 26 |
| 169031 | 1 | 0.015873016 | k: Bacteria; p: Firmicutes; c: Clostridia; o: Clostridiales; f: Veillonellaceae; g: *Phascolarctobacterium*; s: | 27 |
| 171607 | 1 | 0.015873016 | k: Bacteria; p: Bacteroidetes; c: Bacteroidia; o: Bacteroidales; f: S24-7; g: ; s: | 28 |
| 173726 | 28 | 0.444444444 | k: Bacteria; p: Proteobacteria; c: Betaproteobacteria; o: Burkholderiales; f: Alcaligenaceae; g: *Sutterella*; s: | 29 |
| 173773 | 2 | 0.031746032 | k: Bacteria; p: Bacteroidetes; c: Bacteroidia; o: Bacteroidales; f: S24-7; g: ; s: | 30 |
| 174755 | 12 | 0.19047619 | k: Bacteria; p: Actinobacteria; c: Coriobacteriia; o: Coriobacteriales; f: Coriobacteriaceae; g: *Collinsella*; s: *aerofaciens* | 31 |
| 174974 | 12 | 0.19047619 | k: Bacteria; p: Firmicutes; c: Clostridia; o: Clostridiales; f: Lachnospiraceae; g: *Lachnospira*; s: | 32 |
| 175037 | 3 | 0.047619048 | k: Bacteria; p: Firmicutes; c: Clostridia; o: Clostridiales; f: Christensenellaceae; g: ; s: | 33 |
| 176119 | 1 | 0.015873016 | k: Bacteria; p: Bacteroidetes; c: Bacteroidia; o: Bacteroidales; f: S24-7; g: ; s: | 34 |
| 176654 | 1 | 0.015873016 | k: Bacteria; p: Bacteroidetes; c: Bacteroidia; o: Bacteroidales; f: S24-7; g: ; s: | 35 |
| 176705 | 4 | 0.063492063 | k: Bacteria; p: Firmicutes; c: Clostridia; o: Clostridiales; f: Veillonellaceae; g: *Phascolarctobacterium*; s: | 36 |
| 176775 | 47 | 0.746031746 | k: Bacteria; p: Firmicutes; c: Clostridia; o: Clostridiales; f: Veillonellaceae; g: *Phascolarctobacterium*; s: | 37 |
| 177484 | 2 | 0.031746032 | k: Bacteria; p: Firmicutes; c: Clostridia; o: Clostridiales; f: Veillonellaceae; g: ; s: | 38 |
| 177600 | 3 | 0.047619048 | k: Bacteria; p: Firmicutes; c: Clostridia; o: Clostridiales; f: Christensenellaceae; g: ; s: | 39 |
| 177987 | 52 | 0.825396825 | k: Bacteria; p: Firmicutes; c: Clostridia; o: Clostridiales; f: Lachnospiraceae; g: *Lachnospira*; s: | 40 |
| 178001 | 21 | 0.333333333 | k: Bacteria; p: Firmicutes; c: Clostridia; o: Clostridiales; f: Lachnospiraceae; g: *Lachnospira*; s: | 41 |
| 178082 | 13 | 0.206349206 | k: Bacteria; p: Firmicutes; c: Clostridia; o: Clostridiales; f: Lachnospiraceae; g: *Lachnospira*; s: | 42 |
| 178839 | 5 | 0.079365079 | k: Bacteria; p: Firmicutes; c: Clostridia; o: Clostridiales; f: [Mogibacteriaceae]; g: ; s: | 43 |
| 179608 | 2 | 0.031746032 | k: Bacteria; p: Firmicutes; c: Clostridia; o: Clostridiales; f: Christensenellaceae; g: ; s: | 44 |
| 180133 | 1 | 0.015873016 | k: Bacteria; p: Bacteroidetes; c: Bacteroidia; o: Bacteroidales; f: [Barnesiellaceae]; g: ; s: | 45 |
| 180150 | 1 | 0.015873016 | k: Bacteria; p: Bacteroidetes; c: Bacteroidia; o: Bacteroidales; f: S24-7; g: ; s: | 46 |
| 180402 | 47 | 0.746031746 | k: Bacteria; p: Firmicutes; c: Clostridia; o: Clostridiales; f: [Mogibacteriaceae]; g: ; s: | 47 |
| 182456 | 1 | 0.015873016 | k: Bacteria; p: Firmicutes; c: Clostridia; o: Clostridiales; f: Lachnospiraceae; g: *Lachnospira*; s: | 48 |
| 182799 | 56 | 0.888888889 | k: Bacteria; p: Firmicutes; c: Clostridia; o: Clostridiales; f: Lachnospiraceae; g: *Lachnospira*; s: | 49 |
| 182945 | 1 | 0.015873016 | k: Bacteria; p: Bacteroidetes; c: Bacteroidia; o: Bacteroidales; f: S24-7; g: ; s: | 50 |
| 183395 | 2 | 0.031746032 | k: Bacteria; p: Bacteroidetes; c: Bacteroidia; o: Bacteroidales; f: [Barnesiellaceae]; g: ; s: | 51 |
| 183748 | 14 | 0.222222222 | k: Bacteria; p: Firmicutes; c: Clostridia; o: Clostridiales; f: Christensenellaceae; g: ; s: | 52 |
| 184876 | 7 | 0.111111111 | k: Bacteria; p: Firmicutes; c: Clostridia; o: Clostridiales; f: Lachnospiraceae; g: *Lachnospira*; s: | 53 |
| 184940 | 5 | 0.079365079 | k: Bacteria; p: Firmicutes; c: Clostridia; o: Clostridiales; f: Christensenellaceae; g: ; s: | 54 |
| 186351 | 1 | 0.015873016 | k: Bacteria; p: Bacteroidetes; c: Bacteroidia; o: Bacteroidales; f: S24-7; g: ; s: | 55 |
| 186703 | 15 | 0.238095238 | k: Bacteria; p: Actinobacteria; c: Coriobacteriia; o: Coriobacteriales; f: Coriobacteriaceae; g: *Collinsella*; s: *aerofaciens* | 56 |
| 186981 | 22 | 0.349206349 | k: Bacteria; p: Bacteroidetes; c: Bacteroidia; o: Bacteroidales; f: [Barnesiellaceae]; g: ; s: | 57 |

TABLE 5-continued

| Exemplary OTUs Useful in the Present Invention | | | | |
|---|---|---|---|---|
| A[1] | B | C | D[2] | E |
| 187490 | 49 | 0.777777778 | k: Bacteria; p: Actinobacteria; c: Coriobacteriia; o: Coriobacteriales; f: Coriobacteriaceae; g: *Collinsella*; s: | 58 |
| 188789 | 1 | 0.015873016 | k: Bacteria; p: Firmicutes; c: Clostridia; o: Clostridiales; f: Christensenellaceae; g: ; s: | 59 |
| 188881 | 9 | 0.142857143 | k: Bacteria; p: Firmicutes; c: Clostridia; o: Clostridiales; f: Christensenellaceae; g: ; s: | 60 |
| 189294 | 43 | 0.682539683 | k: Bacteria; p: Actinobacteria; c: Coriobacteriia; o: Coriobacteriales; f: Coriobacteriaceae; g: *Collinsella*; s: *aerofaciens* | 61 |
| 189407 | 6 | 0.095238095 | k: Bacteria; p: Firmicutes; c: Clostridia; o: Clostridiales; f: [Mogibacteriaceae]; g: ; s: | 62 |
| 189936 | 4 | 0.063492063 | k: Bacteria; p: Firmicutes; c: Clostridia; o: Clostridiales; f: [Mogibacteriaceae]; g: ; s: | 63 |
| 189960 | 6 | 0.095238095 | k: Bacteria; p: Bacteroidetes; c: Bacteroidia; o: Bacteroidales; f: [Barnesiellaceae]; g: ; s: | 64 |
| 189975 | 3 | 0.047619048 | k: Bacteria; p: Firmicutes; c: Clostridia; o: Clostridiales; f: Christensenellaceae; g: ; s: | 65 |
| 189997 | 49 | 0.777777778 | k: Bacteria; p: Actinobacteria; c: Coriobacteriia; o: Coriobacteriales; f: Coriobacteriaceae; g: *Collinsella*; s: | 66 |
| 190299 | 2 | 0.031746032 | k: Bacteria; p: Firmicutes; c: Clostridia; o: Clostridiales; f: Lachnospiraceae; g: *Lachnospira*; s: | 67 |
| 190975 | 1 | 0.015873016 | k: Bacteria; p: Bacteroidetes; c: Bacteroidia; o: Bacteroidales; f: [Barnesiellaceae]; g: ; s: | 68 |
| 191389 | 7 | 0.111111111 | k: Bacteria; p: Firmicutes; c: Clostridia; o: Clostridiales; f: [Mogibacteriaceae]; g: ; s: | 69 |
| 191595 | 17 | 0.26984127 | k: Bacteria; p: Actinobacteria; c: Coriobacteriia; o: Coriobacteriales; f: Coriobacteriaceae; g: *Collinsella*; s: *aerofaciens* | 70 |
| 192385 | 2 | 0.031746032 | k: Bacteria; p: Firmicutes; c: Clostridia; o: Clostridiales; f: Christensenellaceae; g: ; s: | 71 |
| 192906 | 1 | 0.015873016 | k: Bacteria; p: Bacteroidetes; c: Bacteroidia; o: Bacteroidales; f: S24-7; g: ; s: | 72 |
| 193191 | 7 | 0.111111111 | k: Bacteria; p: Firmicutes; c: Clostridia; o: Clostridiales; f: Lachnospiraceae; g: *Lachnospira*; s: | 73 |
| 193436 | 9 | 0.142857143 | k: Bacteria; p: Actinobacteria; c: Coriobacteriia; o: Coriobacteriales; f: Coriobacteriaceae; g: *Collinsella*; s: | 74 |
| 193575 | 39 | 0.619047619 | k: Bacteria; p: Actinobacteria; c: Coriobacteriia; o: Coriobacteriales; f: Coriobacteriaceae; g: *Collinsella*; s: *aerofaciens* | 75 |
| 194048 | 1 | 0.015873016 | k: Bacteria; p: Bacteroidetes; c: Bacteroidia; o: Bacteroidales; f: S24-7; g: ; s: | 76 |
| 194110 | 24 | 0.380952381 | k: Bacteria; p: Firmicutes; c: Clostridia; o: Clostridiales; f: Lachnospiraceae; g: *Lachnospira*; s: | 77 |
| 194360 | 10 | 0.158730159 | k: Bacteria; p: Proteobacteria; c: Betaproteobacteria; o: Burkholderiales; f: Alcaligenaceae; g: *Sutterella*; s: | 78 |
| 194673 | 1 | 0.015873016 | k: Bacteria; p: Bacteroidetes; c: Bacteroidia; o: Bacteroidales; f: S24-7; g: ; s: | 79 |
| 194707 | 6 | 0.095238095 | k: Bacteria; p: Firmicutes; c: Clostridia; o: Clostridiales; f: Lachnospiraceae; g: *Lachnospira*; s: | 80 |
| 194727 | 33 | 0.523809524 | k: Bacteria; p: Firmicutes; c: Clostridia; o: Clostridiales; f: Lachnospiraceae; g: *Lachnospira*; s: | 81 |
| 195015 | 15 | 0.238095238 | k: Bacteria; p: Firmicutes; c: Clostridia; o: Clostridiales; f: Lachnospiraceae; g: *Lachnospira*; s: | 82 |
| 195466 | 6 | 0.095238095 | k: Bacteria; p: Bacteroidetes; c: Bacteroidia; o: Bacteroidales; f: S24-7; g: ; s: | 83 |
| 195752 | 28 | 0.444444444 | k: Bacteria; p: Firmicutes; c: Clostridia; o: Clostridiales; f: Lachnospiraceae; g: *Lachnospira*; s: | 84 |
| 196462 | 13 | 0.206349206 | k: Bacteria; p: Firmicutes; c: Clostridia; o: Clostridiales; f: Christensenellaceae; g: ; s: | 85 |
| 197107 | 1 | 0.015873016 | k: Bacteria; p: Firmicutes; c: Clostridia; o: Clostridiales; f: Lachnospiraceae; g: *Lachnospira*; s: | 86 |
| 197341 | 7 | 0.111111111 | k: Bacteria; p: Firmicutes; c: Clostridia; o: Clostridiales; f: Lachnospiraceae; g: *Lachnospira*; s: | 87 |
| 197517 | 2 | 0.031746032 | k: Bacteria; p: Bacteroidetes; c: Bacteroidia; o: Bacteroidales; f: [Barnesiellaceae]; g: ; s: | 88 |
| 197581 | 29 | 0.46031746 | k: Bacteria; p: Firmicutes; c: Clostridia; o: Clostridiales; f: Lachnospiraceae; g: *Lachnospira*; s: | 89 |
| 197649 | 7 | 0.111111111 | k: Bacteria; p: Firmicutes; c: Clostridia; o: Clostridiales; f: Lachnospiraceae; g: *Lachnospira*; s: | 90 |
| 198034 | 2 | 0.031746032 | k: Bacteria; p: Firmicutes; c: Clostridia; o: Clostridiales; f: Lachnospiraceae; g: *Lachnospira*; s: | 91 |
| 198909 | 26 | 0.412698413 | k: Bacteria; p: Firmicutes; c: Clostridia; o: Clostridiales; f: Lachnospiraceae; g: *Lachnospira*; s: | 92 |
| 199354 | 27 | 0.428571429 | k: Bacteria; p: Bacteroidetes; c: Bacteroidia; o: Bacteroidales; f: [Barnesiellaceae]; g: ; s: | 93 |
| 199421 | 33 | 0.523809524 | k: Bacteria; p: Firmicutes; c: Clostridia; o: Clostridiales; f: Lachnospiraceae; g: *Lachnospira*; s: | 94 |
| 199707 | 1 | 0.015873016 | k: Bacteria; p: Bacteroidetes; c: Bacteroidia; o: Bacteroidales; f: S24-7; g: ; s: | 95 |

TABLE 5-continued

Exemplary OTUs Useful in the Present Invention

| A[1] | B | C | D[2] | E |
|---|---|---|---|---|
| 204088 | 1 | 0.015873016 | k: Bacteria; p: Bacteroidetes; c: Bacteroidia; o: Bacteroidales; f: S24-7; g: ; s: | 96 |
| 205981 | 2 | 0.031746032 | k: Bacteria; p: Bacteroidetes; c: Bacteroidia; o: Bacteroidales; f: S24-7; g: ; s: | 97 |
| 207340 | 3 | 0.047619048 | k: Bacteria; p: Firmicutes; c: Clostridia; o: Clostridiales; f: [Mogibacteriaceae]; g: ; s: | 98 |
| 207487 | 33 | 0.523809524 | k: Bacteria; p: Firmicutes; c: Clostridia; o: Clostridiales; f: Lachnospiraceae; g: *Lachnospira*; s: | 99 |
| 208539 | 1 | 0.015873016 | k: Bacteria; p: Firmicutes; c: Clostridia; o: Clostridiales; f: [Mogibacteriaceae]; g: ; s: | 100 |
| 210542 | 2 | 0.031746032 | k: Bacteria; p: Firmicutes; c: Clostridia; o: Clostridiales; f: Lachnospiraceae; g: *Lachnospira*; s: | 101 |
| 213394 | 16 | 0.253968254 | k: Bacteria; p: Firmicutes; c: Clostridia; o: Clostridiales; f: Lachnospiraceae; g: *Lachnospira*; s: | 102 |
| 214036 | 44 | 0.698412698 | k: Bacteria; p: Firmicutes; c: Clostridia; o: Clostridiales; f: [Mogibacteriaceae]; g: ; s: | 103 |
| 215097 | 9 | 0.142857143 | k: Bacteria; p: Proteobacteria; c: Betaproteobacteria; o: Burkholderiales; f: Alcaligenaceae; g: *Sutterella*; s: | 104 |
| 215214 | 2 | 0.031746032 | k: Bacteria; p: Bacteroidetes; c: Bacteroidia; o: Bacteroidales; f: S24-7; g: ; s: | 105 |
| 216010 | 21 | 0.333333333 | k: Bacteria; p: Firmicutes; c: Clostridia; o: Clostridiales; f: [Mogibacteriaceae]; g: ; s: | 106 |
| 216290 | 1 | 0.015873016 | k: Bacteria; p: Bacteroidetes; c: Bacteroidia; o: Bacteroidales; f: S24-7; g: ; s: | 107 |
| 216902 | 1 | 0.015873016 | k: Bacteria; p: Bacteroidetes; c: Bacteroidia; o: Bacteroidales; f: S24-7; g: ; s: | 108 |
| 217109 | 8 | 0.126984127 | k: Bacteria; p: Firmicutes; c: Clostridia; o: Clostridiales; f: Christensenellaceae; g: ; s: | 109 |
| 228748 | 5 | 0.079365079 | k: Bacteria; p: Firmicutes; c: Clostridia; o: Clostridiales; f: Christensenellaceae; g: ; s: | 110 |
| 229905 | 1 | 0.015873016 | k: Bacteria; p: Firmicutes; c: Clostridia; o: Clostridiales; f: [Mogibacteriaceae]; g: ; s: | 111 |
| 233052 | 10 | 0.158730159 | k: Bacteria; p: Firmicutes; c: Clostridia; o: Clostridiales; f: Christensenellaceae; g: ; s: | 112 |
| 234447 | 1 | 0.015873016 | k: Bacteria; p: Firmicutes; c: Clostridia; o: Clostridiales; f: Christensenellaceae; g: ; s: | 113 |
| 258485 | 1 | 0.015873016 | k: Bacteria; p: Bacteroidetes; c: Bacteroidia; o: Bacteroidales; f: S24-7; g: ; s: | 114 |
| 259557 | 1 | 0.015873016 | k: Bacteria; p: Bacteroidetes; c: Bacteroidia; o: Bacteroidales; f: S24-7; g: ; s: | 115 |
| 259859 | 1 | 0.015873016 | k: Bacteria; p: Bacteroidetes; c: Bacteroidia; o: Bacteroidales; f: S24-7; g: ; s: | 116 |
| 261572 | 1 | 0.015873016 | k: Bacteria; p: Firmicutes; c: Clostridia; o: Clostridiales; f: [Mogibacteriaceae]; g: ; s: | 117 |
| 263518 | 4 | 0.063492063 | k: Bacteria; p: Proteobacteria; c: Deltaproteobacteria; o: Desulfovibrionales; f: Desulfovibrionaceae; g: ; s: | 118 |
| 266976 | 1 | 0.015873016 | k: Bacteria; p: Bacteroidetes; c: Bacteroidia; o: Bacteroidales; f: S24-7; g: ; s: | 119 |
| 270162 | 6 | 0.095238095 | k: Bacteria; p: Firmicutes; c: Clostridia; o: Clostridiales; f: Veillonellaceae; g: *Phascolarctobacterium*; s: | 120 |
| 270451 | 1 | 0.015873016 | k: Bacteria; p: Bacteroidetes; c: Bacteroidia; o: Bacteroidales; f: S24-7; g: ; s: | 121 |
| 273208 | 1 | 0.015873016 | k: Bacteria; p: Bacteroidetes; c: Bacteroidia; o: Bacteroidales; f: S24-7; g: ; s: | 122 |
| 275237 | 1 | 0.015873016 | k: Bacteria; p: Firmicutes; c: Clostridia; o: Clostridiales; f: Veillonellaceae; g: *Phascolarctobacterium*; s: | 123 |
| 278675 | 1 | 0.015873016 | k: Bacteria; p: Bacteroidetes; c: Bacteroidia; o: Bacteroidales; f: S24-7; g: ; s: | 124 |
| 287514 | 38 | 0.603174603 | k: Bacteria; p: Actinobacteria; c: Coriobacteriia; o: Coriobacteriales; f: Coriobacteriaceae; g: *Collinsella*; s: *aerofaciens* | 125 |
| 289110 | 5 | 0.079365079 | k: Bacteria; p: Firmicutes; c: Clostridia; o: Clostridiales; f: Veillonellaceae; g: *Phascolarctobacterium*; s: | 126 |
| 289752 | 6 | 0.095238095 | k: Bacteria; p: Firmicutes; c: Clostridia; o: Clostridiales; f: Veillonellaceae; g: *Phascolarctobacterium*; s: | 127 |
| 291315 | 1 | 0.015873016 | k: Bacteria; p: Firmicutes; c: Clostridia; o: Clostridiales; f: Veillonellaceae; g: *Phascolarctobacterium*; s: | 128 |
| 293883 | 6 | 0.095238095 | k: Bacteria; p: Firmicutes; c: Clostridia; o: Clostridiales; f: Veillonellaceae; g: *Phascolarctobacterium*; s: | 129 |
| 294909 | 1 | 0.015873016 | k: Bacteria; p: Bacteroidetes; c: Bacteroidia; o: Bacteroidales; f: [Barnesiellaceae]; g: ; s: | 130 |
| 296945 | 25 | 0.396825397 | k: Bacteria; p: Proteobacteria; c: Betaproteobacteria; o: Burkholderiales; f: Alcaligenaceae; g: *Sutterella*; s: | 131 |
| 302617 | 9 | 0.142857143 | k: Bacteria; p: Firmicutes; c: Clostridia; o: Clostridiales; f: Lachnospiraceae; g: *Lachnospira*; s: | 132 |
| 303864 | 5 | 0.079365079 | k: Bacteria; p: Firmicutes; c: Clostridia; o: Clostridiales; f: Lachnospiraceae; g: *Lachnospira*; s: | 133 |

TABLE 5-continued

| Exemplary OTUs Useful in the Present Invention | | | | |
|---|---|---|---|---|
| A[1] | B | C | D[2] | E |
| 305016 | 1 | 0.015873016 | k: Bacteria; p: Firmicutes; c: Clostridia; o: Clostridiales; f: Lachnospiraceae; g: *Lachnospira*; s: | 134 |
| 305608 | 4 | 0.063492063 | k: Bacteria; p: Firmicutes; c: Clostridia; o: Clostridiales; f: Veillonellaceae; g: *Phascolarctobacterium*; s: | 135 |
| 307127 | 5 | 0.079365079 | k: Bacteria; p: Firmicutes; c: Clostridia; o: Clostridiales; f: Lachnospiraceae; g: *Lachnospira*; s: | 136 |
| 308912 | 1 | 0.015873016 | k: Bacteria; p: Firmicutes; c: Clostridia; o: Clostridiales; f: Christensenellaceae; g: ; s: | 137 |
| 309433 | 3 | 0.047619048 | k: Bacteria; p: Firmicutes; c: Clostridia; o: Clostridiales; f: Lachnospiraceae; g: *Lachnospira*; s: | 138 |
| 312070 | 14 | 0.222222222 | k: Bacteria; p: Firmicutes; c: Clostridia; o: Clostridiales; f: [Mogibacteriaceae]; g: ; s: | 139 |
| 313672 | 2 | 0.031746032 | k: Bacteria; p: Firmicutes; c: Clostridia; o: Clostridiales; f: Lachnospiraceae; g: *Lachnospira*; s: | 140 |
| 315831 | 2 | 0.031746032 | k: Bacteria; p: Firmicutes; c: Clostridia; o: Clostridiales; f: [Mogibacteriaceae]; g: ; s: | 141 |
| 315846 | 9 | 0.142857143 | k: Bacteria; p: Bacteroidetes; c: Bacteroidia; o: Bacteroidales; f: [Barnesiellaceae]; g: ; s: | 142 |
| 316629 | 1 | 0.015873016 | k: Bacteria; p: Bacteroidetes; c: Bacteroidia; o: Bacteroidales; f: S24-7; g: ; s: | 143 |
| 316732 | 27 | 0.428571429 | k: Bacteria; p: Firmicutes; c: Clostridia; o: Clostridiales; f: Lachnospiraceae; g: *Lachnospira*; s: | 144 |
| 318777 | 13 | 0.206349206 | k: Bacteria; p: Firmicutes; c: Clostridia; o: Clostridiales; f: Veillonellaceae; g: *Phascolarctobacterium*; s: | 145 |
| 318865 | 4 | 0.063492063 | k: Bacteria; p: Firmicutes; c: Clostridia; o: Clostridiales; f: Lachnospiraceae; g: *Lachnospira*; s: | 146 |
| 319260 | 3 | 0.047619048 | k: Bacteria; p: Firmicutes; c: Clostridia; o: Clostridiales; f: [Mogibacteriaceae]; g: ; s: | 147 |
| 319455 | 20 | 0.317460317 | k: Bacteria; p: Firmicutes; c: Clostridia; o: Clostridiales; f: Christensenellaceae; g: ; s: | 148 |
| 320322 | 29 | 0.46031746 | k: Bacteria; p: Firmicutes; c: Clostridia; o: Clostridiales; f: Lachnospiraceae; g: *Lachnospira*; s: | 149 |
| 322835 | 15 | 0.238095238 | k: Bacteria; p: Firmicutes; c: Clostridia; o: Clostridiales; f: Lachnospiraceae; g: *Lachnospira*; s: | 150 |
| 322962 | 1 | 0.015873016 | k: Bacteria; p: Firmicutes; c: Clostridia; o: Clostridiales; f: Christensenellaceae; g: ; s: | 151 |
| 324882 | 3 | 0.047619048 | k: Bacteria; p: Firmicutes; c: Clostridia; o: Clostridiales; f: [Mogibacteriaceae]; g: ; s: | 152 |
| 325599 | 4 | 0.063492063 | k: Bacteria; p: Firmicutes; c: Clostridia; o: Clostridiales; f: Lachnospiraceae; g: *Lachnospira*; s: | 153 |
| 327598 | 8 | 0.126984127 | k: Bacteria; p: Firmicutes; c: Clostridia; o: Clostridiales; f: Christensenellaceae; g: ; s: | 154 |
| 329688 | 10 | 0.158730159 | k: Bacteria; p: Actinobacteria; c: Coriobacteriia; o: Coriobacteriales; f: Coriobacteriaceae; g: *Collinsella*; s: *stercoris* | 155 |
| 332027 | 7 | 0.111111111 | k: Bacteria; p: Firmicutes; c: Clostridia; o: Clostridiales; f: Christensenellaceae; g: ; s: | 156 |
| 332163 | 14 | 0.222222222 | k: Bacteria; p: Firmicutes; c: Clostridia; o: Clostridiales; f: Lachnospiraceae; g: *Lachnospira*; s: | 157 |
| 333380 | 4 | 0.063492063 | k: Bacteria; p: Proteobacteria; c: Betaproteobacteria; o: Burkholderiales; f: Alcaligenaceae; g: *Sutterella*; s: | 158 |
| 338195 | 3 | 0.047619048 | k: Bacteria; p: Firmicutes; c: Clostridia; o: Clostridiales; f: Christensenellaceae; g: ; s: | 159 |
| 342375 | 3 | 0.047619048 | k: Bacteria; p: Firmicutes; c: Clostridia; o: Clostridiales; f: Lachnospiraceae; g: *Lachnospira*; s: | 160 |
| 346302 | 3 | 0.047619048 | k: Bacteria; p: Firmicutes; c: Clostridia; o: Clostridiales; f: Lachnospiraceae; g: *Lachnospira*; s: | 161 |
| 346793 | 2 | 0.031746032 | k: Bacteria; p: Firmicutes; c: Clostridia; o: Clostridiales; f: Veillonellaceae; g: *Phascolarctobacterium*; s: | 162 |
| 349257 | 27 | 0.428571429 | k: Bacteria; p: Firmicutes; c: Clostridia; o: Clostridiales; f: Lachnospiraceae; g: *Lachnospira*; s: | 163 |
| 350255 | 7 | 0.111111111 | k: Bacteria; p: Firmicutes; c: Clostridia; o: Clostridiales; f: Veillonellaceae; g: ; s: | 164 |
| 350865 | 18 | 0.285714286 | k: Bacteria; p: Firmicutes; c: Clostridia; o: Clostridiales; f: Lachnospiraceae; g: *Lachnospira*; s: | 165 |
| 355746 | 1 | 0.015873016 | k: Bacteria; p: Bacteroidetes; c: Bacteroidia; o: Bacteroidales; f: S24-7; g: ; s: | 166 |
| 355975 | 3 | 0.047619048 | k: Bacteria; p: Firmicutes; c: Clostridia; o: Clostridiales; f: Lachnospiraceae; g: *Lachnospira*; s: | 167 |
| 356644 | 8 | 0.126984127 | k: Bacteria; p: Firmicutes; c: Clostridia; o: Clostridiales; f: Lachnospiraceae; g: *Lachnospira*; s: | 168 |
| 357305 | 2 | 0.031746032 | k: Bacteria; p: Bacteroidetes; c: Bacteroidia; o: Bacteroidales; f: S24-7; g: ; s: | 169 |
| 357849 | 45 | 0.714285714 | k: Bacteria; p: Actinobacteria; c: Coriobacteriia; o: Coriobacteriales; f: Coriobacteriaceae; g: *Collinsella*; s: *aerofaciens* | 170 |
| 363519 | 21 | 0.333333333 | k: Bacteria; p: Firmicutes; c: Clostridia; o: Clostridiales; f: Christensenellaceae; g: ; s: | 171 |

TABLE 5-continued

Exemplary OTUs Useful in the Present Invention

| A[1] | B | C | D[2] | E |
|---|---|---|---|---|
| 363794 | 22 | 0.349206349 | k: Bacteria; p: Actinobacteria; c: Coriobacteriia; o: Coriobacteriales; f: Coriobacteriaceae; g: *Collinsella*; s: *aerofaciens* | 172 |
| 365181 | 12 | 0.19047619 | k: Bacteria; p: Actinobacteria; c: Coriobacteriia; o: Coriobacteriales; f: Coriobacteriaceae; g: *Collinsella*; s: *aerofaciens* | 173 |
| 365628 | 24 | 0.380952381 | k: Bacteria; p: Firmicutes; c: Clostridia; o: Clostridiales; f: Veillonellaceae; g: *Phascolarctobacterium*; s: | 174 |
| 366386 | 2 | 0.031746032 | k: Bacteria; p: Firmicutes; c: Clostridia; o: Clostridiales; f: Veillonellaceae; g: ; s: | 175 |
| 368175 | 4 | 0.063492063 | k: Bacteria; p: Actinobacteria; c: Coriobacteriia; o: Coriobacteriales; f: Coriobacteriaceae; g: *Collinsella*; s: *aerofaciens* | 176 |
| 368711 | 10 | 0.158730159 | k: Bacteria; p: Firmicutes; c: Clostridia; o: Clostridiales; f: Christensenellaceae; g: ; s: | 177 |
| 369486 | 53 | 0.841269841 | k: Bacteria; p: Firmicutes; c: Clostridia; o: Clostridiales; f: Lachnospiraceae; g: *Lachnospira*; s: | 178 |
| 370075 | 4 | 0.063492063 | k: Bacteria; p: Firmicutes; c: Clostridia; o: Clostridiales; f: [Mogibacteriaceae]; g: ; s: | 179 |
| 370098 | 22 | 0.349206349 | k: Bacteria; p: Firmicutes; c: Clostridia; o: Clostridiales; f: Lachnospiraceae; g: *Lachnospira*; s: | 180 |
| 381979 | 1 | 0.015873016 | k: Bacteria; p: Bacteroidetes; c: Bacteroidia; o: Bacteroidales; f: S24-7; g: ; s: | 181 |
| 414949 | 4 | 0.063492063 | k: Bacteria; p: Actinobacteria; c: Coriobacteriia; o: Coriobacteriales; f: Coriobacteriaceae; g: *Collinsella*; s: | 182 |
| 415315 | 1 | 0.015873016 | k: Bacteria; p: Actinobacteria; c: Coriobacteriia; o: Coriobacteriales; f: Coriobacteriaceae; g: *Collinsella*; s: | 183 |
| 437137 | 6 | 0.095238095 | k: Bacteria; p: Proteobacteria; c: Betaproteobacteria; o: Burkholderiales; f: Alcaligenaceae; g: *Sutterella*; s: | 184 |
| 512494 | 1 | 0.015873016 | k: Bacteria; p: Firmicutes; c: Clostridia; o: Clostridiales; f: Veillonellaceae; g: *Phascolarctobacterium*; s: | 185 |
| 513021 | 1 | 0.015873016 | k: Bacteria; p: Bacteroidetes; c: Bacteroidia; o: Bacteroidales; f: S24-7; g: ; s: | 186 |
| 516909 | 1 | 0.015873016 | k: Bacteria; p: Bacteroidetes; c: Bacteroidia; o: Bacteroidales; f: S24-7; g: ; s: | 187 |
| 519000 | 4 | 0.063492063 | k: Bacteria; p: Bacteroidetes; c: Bacteroidia; o: Bacteroidales; f: S24-7; g: ; s: | 188 |
| 526682 | 7 | 0.111111111 | k: Bacteria; p: Actinobacteria; c: Actinobacteria; o: Actinomycetales; f: Actinomycetaceae; g: *Actinomyces*; s: | 189 |
| 529652 | 3 | 0.047619048 | k: Bacteria; p: Proteobacteria; c: Betaproteobacteria; o: Burkholderiales; f: Alcaligenaceae; g: *Sutterella*; s: | 190 |
| 536584 | 2 | 0.031746032 | k: Bacteria; p: Firmicutes; c: Clostridia; o: Clostridiales; f: Christensenellaceae; g: ; s: | 191 |
| 555547 | 17 | 0.26984127 | k: Bacteria; p: Firmicutes; c: Clostridia; o: Clostridiales; f: Christensenellaceae; g: ; s: | 192 |
| 556835 | 13 | 0.206349206 | k: Bacteria; p: Firmicutes; c: Clostridia; o: Clostridiales; f: Veillonellaceae; g: *Phascolarctobacterium*; s: | 193 |
| 562244 | 4 | 0.063492063 | k: Bacteria; p: Proteobacteria; c: Betaproteobacteria; o: Burkholderiales; f: Alcaligenaceae; g: *Sutterella*; s: | 194 |
| 562410 | 8 | 0.126984127 | k: Bacteria; p: Firmicutes; c: Clostridia; o: Clostridiales; f: Christensenellaceae; g: ; s: | 195 |
| 565136 | 4 | 0.063492063 | k: Bacteria; p: Actinobacteria; c: Actinobacteria; o: Actinomycetales; f: Actinomycetaceae; g: *Actinomyces*; s: | 196 |
| 585989 | 4 | 0.063492063 | k: Bacteria; p: Firmicutes; c: Clostridia; o: Clostridiales; f: Veillonellaceae; g: *Phascolarctobacterium*; s: | 197 |
| 586453 | 19 | 0.301587302 | k: Bacteria; p: Firmicutes; c: Clostridia; o: Clostridiales; f: Christensenellaceae; g: ; s: | 198 |
| 591439 | 10 | 0.158730159 | k: Bacteria; p: Firmicutes; c: Clostridia; o: Clostridiales; f: [Mogibacteriaceae]; g: ; s: | 199 |
| 621166 | 1 | 0.015873016 | k: Bacteria; p: Firmicutes; c: Clostridia; o: Clostridiales; f: Veillonellaceae; g: ; s: | 200 |
| 644244 | 3 | 0.047619048 | k: Bacteria; p: Firmicutes; c: Clostridia; o: Clostridiales; f: Christensenellaceae; g: ; s: | 201 |
| 663500 | 2 | 0.031746032 | k: Bacteria; p: Firmicutes; c: Clostridia; o: Clostridiales; f: Veillonellaceae; g: *Phascolarctobacterium*; s: | 202 |
| 686711 | 3 | 0.047619048 | k: Bacteria; p: Firmicutes; c: Clostridia; o: Clostridiales; f: Christensenellaceae; g: ; s: | 203 |
| 731422 | 3 | 0.047619048 | k: Bacteria; p: Firmicutes; c: Clostridia; o: Clostridiales; f: Veillonellaceae; g: *Phascolarctobacterium*; s: | 204 |
| 740158 | 3 | 0.047619048 | k: Bacteria; p: Firmicutes; c: Clostridia; o: Clostridiales; f: Veillonellaceae; g: *Phascolarctobacterium*; s: | 205 |
| 790466 | 1 | 0.015873016 | k: Bacteria; p: Firmicutes; c: Clostridia; o: Clostridiales; f: [Mogibacteriaceae]; g: ; s: | 206 |
| 801210 | 1 | 0.015873016 | k: Bacteria; p: Proteobacteria; c: Betaproteobacteria; o: Burkholderiales; f: Alcaligenaceae; g: *Sutterella*; s: | 207 |
| 820764 | 1 | 0.015873016 | k: Bacteria; p: Firmicutes; c: Clostridia; o: Clostridiales; f: Veillonellaceae; g: ; s: | 208 |
| 832089 | 10 | 0.158730159 | k: Bacteria; p: Firmicutes; c: Clostridia; o: Clostridiales; f: [Mogibacteriaceae]; g: ; s: | 209 |

TABLE 5-continued

Exemplary OTUs Useful in the Present Invention

| A[1] | B | C | D[2] | E |
|---|---|---|---|---|
| 840279 | 1 | 0.015873016 | k: Bacteria; p: Bacteroidetes; c: Bacteroidia; o: Bacteroidales; f: [Barnesiellaceae]; g: ; s: | 210 |
| 841635 | 20 | 0.317460317 | k: Bacteria; p: Proteobacteria; c: Betaproteobacteria; o: Burkholderiales; f: Alcaligenaceae; g: *Sutterella*; s: | 211 |
| 843553 | 4 | 0.063492063 | k: Bacteria; p: Firmicutes; c: Clostridia; o: Clostridiales; f: Lachnospiraceae; g: *Lachnospira*; s: | 212 |
| 844589 | 1 | 0.015873016 | k: Bacteria; p: Bacteroidetes; c: Bacteroidia; o: Bacteroidales; f: S24-7; g: ; s: | 213 |
| 846798 | 8 | 0.126984127 | k: Bacteria; p: Bacteroidetes; c: Bacteroidia; o: Bacteroidales; f: [Barnesiellaceae]; g: ; s: | 214 |
| 847711 | 1 | 0.015873016 | k: Bacteria; p: Firmicutes; c: Clostridia; o: Clostridiales; f: Christensenellaceae; g: ; s: | 215 |
| 848669 | 11 | 0.174603175 | k: Bacteria; p: Proteobacteria; c: Betaproteobacteria; o: Burkholderiales; f: Alcaligenaceae; g: *Sutterella*; s: | 216 |
| 875735 | 8 | 0.126984127 | k: Bacteria; p: Actinobacteria; c: Actinobacteria; o: Actinomycetales; f: Actinomycetaceae; g: *Actinomyces*; s: | 217 |
| 890882 | 4 | 0.063492063 | k: Bacteria; p: Actinobacteria; c: Actinobacteria; o: Actinomycetales; f: Actinomycetaceae; g: *Actinomyces*; s: | 218 |
| 916143 | 2 | 0.031746032 | k: Bacteria; p: Firmicutes; c: Clostridia; o: Clostridiales; f: Veillonellaceae; g: *Phascolarctobacterium*; s: | 219 |
| 955102 | 7 | 0.111111111 | k: Bacteria; p: Actinobacteria; c: Actinobacteria; o: Actinomycetales; f: Actinomycetaceae; g: *Actinomyces*; s: | 220 |
| 1029949 | 18 | 0.285714286 | k: Bacteria; p: Firmicutes; c: Clostridia; o: Clostridiales; f: Lachnospiraceae; g: *Lachnospira*; s: | 221 |
| 1089121 | 5 | 0.079365079 | k: Bacteria; p: Actinobacteria; c: Actinobacteria; o: Actinomycetales; f: Actinomycetaceae; g: *Actinomyces*; s: | 222 |
| 1105376 | 2 | 0.031746032 | k: Bacteria; p: Proteobacteria; c: Betaproteobacteria; o: Burkholderiales; f: Alcaligenaceae; g: *Sutterella*; s: | 223 |
| 1108377 | 1 | 0.015873016 | k: Bacteria; p: Bacteroidetes; c: Bacteroidia; o: Bacteroidales; f: S24-7; g: ; s: | 224 |
| 1108745 | 3 | 0.047619048 | k: Bacteria; p: Firmicutes; c: Clostridia; o: Clostridiales; f: [Mogibacteriaceae]; g: ; s: | 225 |
| 1584173 | 3 | 0.047619048 | k: Bacteria; p: Bacteroidetes; c: Bacteroidia; o: Bacteroidales; f: [Barnesiellaceae]; g: ; s: | 226 |
| 1602307 | 17 | 0.26984127 | k: Bacteria; p: Proteobacteria; c: Betaproteobacteria; o: Burkholderiales; f: Alcaligenaceae; g: *Sutterella*; s: | 227 |
| 1624383 | 24 | 0.380952381 | k: Bacteria; p: Firmicutes; c: Clostridia; o: Clostridiales; f: Lachnospiraceae; g: *Lachnospira*; s: | 228 |
| 1811927 | 51 | 0.80952381 | k: Bacteria; p: Actinobacteria; c: Coriobacteriia; o: Coriobacteriales; f: Coriobacteriaceae; g: *Collinsella*; s: *aerofaciens* | 229 |
| 1820513 | 9 | 0.142857143 | k: Bacteria; p: Proteobacteria; c: Betaproteobacteria; o: Burkholderiales; f: Alcaligenaceae; g: *Sutterella*; s: | 230 |
| 1910658 | 24 | 0.380952381 | k: Bacteria; p: Bacteroidetes; c: Bacteroidia; o: Bacteroidales; f: [Barnesiellaceae]; g: ; s: | 231 |
| 1974536 | 2 | 0.031746032 | k: Bacteria; p: Proteobacteria; c: Betaproteobacteria; o: Burkholderiales; f: Alcaligenaceae; g: *Sutterella*; s: | 232 |
| 2201995 | 28 | 0.444444444 | k: Bacteria; p: Proteobacteria; c: Betaproteobacteria; o: Burkholderiales; f: Alcaligenaceae; g: *Sutterella*; s: | 233 |
| 2212505 | 1 | 0.015873016 | k: Bacteria; p: Bacteroidetes; c: Bacteroidia; o: Bacteroidales; f: S24-7; g: ; s: | 234 |
| 2233608 | 1 | 0.015873016 | k: Bacteria; p: Bacteroidetes; c: Bacteroidia; o: Bacteroidales; f: S24-7; g: ; s: | 235 |
| 2256425 | 12 | 0.19047619 | k: Bacteria; p: Firmicutes; c: Clostridia; o: Clostridiales; f: Christensenellaceae; g: ; s: | 236 |
| 2313540 | 23 | 0.365079365 | k: Bacteria; p: Firmicutes; c: Clostridia; o: Clostridiales; f: Lachnospiraceae; g: *Lachnospira*; s: | 237 |
| 2442706 | 40 | 0.634920635 | k: Bacteria; p: Firmicutes; c: Clostridia; o: Clostridiales; f: Christensenellaceae; g: ; s: | 238 |
| 2710761 | 1 | 0.015873016 | k: Bacteria; p: Firmicutes; c: Clostridia; o: Clostridiales; f: Veillonellaceae; g: *Phascolarctobacterium*; s: | 239 |
| 2783114 | 1 | 0.015873016 | k: Bacteria; p: Bacteroidetes; c: Bacteroidia; o: Bacteroidales; f: S24-7; g: ; s: | 240 |
| 2801994 | 1 | 0.015873016 | k: Bacteria; p: Firmicutes; c: Clostridia; o: Clostridiales; f: Veillonellaceae; g: *Phascolarctobacterium*; s: | 241 |
| 2963287 | 3 | 0.047619048 | k: Bacteria; p: Firmicutes; c: Clostridia; o: Clostridiales; f: Christensenellaceae; g: ; s: | 242 |
| 3023610 | 21 | 0.333333333 | k: Bacteria; p: Firmicutes; c: Clostridia; o: Clostridiales; f: Lachnospiraceae; g: *Lachnospira*; s: | 243 |
| 3090117 | 2 | 0.031746032 | k: Bacteria; p: Bacteroidetes; c: Bacteroidia; o: Bacteroidales; f: [Barnesiellaceae]; g: ; s: | 244 |
| 3115852 | 7 | 0.111111111 | k: Bacteria; p: Bacteroidetes; c: Bacteroidia; o: Bacteroidales; f: S24-7; g: ; s: | 245 |
| 3123133 | 4 | 0.063492063 | k: Bacteria; p: Proteobacteria; c: Betaproteobacteria; o: Burkholderiales; f: Alcaligenaceae; g: *Sutterella*; s: | 246 |
| 3138798 | 24 | 0.380952381 | k: Bacteria; p: Firmicutes; c: Clostridia; o: Clostridiales; f: Veillonellaceae; g: *Phascolarctobacterium*; s: | 247 |

TABLE 5-continued

| Exemplary OTUs Useful in the Present Invention | | | | |
|---|---|---|---|---|
| A[1] | B | C | D[2] | E |
| 3160267 | 8 | 0.126984127 | k: Bacteria; p: Bacteroidetes; c: Bacteroidia; o: Bacteroidales; f: [Barnesiellaceae]; g: ; s: | 248 |
| 3190479 | 2 | 0.031746032 | k: Bacteria; p: Firmicutes; c: Clostridia; o: Clostridiales; f: Christensenellaceae; g: ; s: | 249 |
| 3369303 | 2 | 0.031746032 | k: Bacteria; p: Firmicutes; c: Clostridia; o: Clostridiales; f: [Mogibacteriaceae]; g: ; s: | 250 |
| 3424188 | 1 | 0.015873016 | k: Bacteria; p: Firmicutes; c: Clostridia; o: Clostridiales; f: Lachnospiraceae; g: *Lachnospira*; s: | 251 |
| 3507351 | 6 | 0.095238095 | k: Bacteria; p: Firmicutes; c: Clostridia; o: Clostridiales; f: Veillonellaceae; g: *Phascolarctobacterium*; s: | 252 |
| 3522002 | 3 | 0.047619048 | k: Bacteria; p: Firmicutes; c: Clostridia; o: Clostridiales; f: [Mogibacteriaceae]; g: ; s: | 253 |
| 3613745 | 7 | 0.111111111 | k: Bacteria; p: Firmicutes; c: Clostridia; o: Clostridiales; f: Lachnospiraceae; g: *Lachnospira*; s: | 254 |
| 3805726 | 4 | 0.063492063 | k: Bacteria; p: Firmicutes; c: Clostridia; o: Clostridiales; f: [Mogibacteriaceae]; g: ; s: | 255 |
| 4033995 | 10 | 0.158730159 | k: Bacteria; p: Firmicutes; c: Clostridia; o: Clostridiales; f: Veillonellaceae; g: ; s: | 256 |
| 4039230 | 25 | 0.396825397 | k: Bacteria; p: Firmicutes; c: Clostridia; o: Clostridiales; f: Lachnospiraceae; g: *Lachnospira*; s: | 257 |
| 4060645 | 7 | 0.111111111 | k: Bacteria; p: Firmicutes; c: Clostridia; o: Clostridiales; f: Lachnospiraceae; g: *Lachnospira*; s: | 258 |
| 4093791 | 1 | 0.015873016 | k: Bacteria; p: Firmicutes; c: Clostridia; o: Clostridiales; f: [Mogibacteriaceae]; g: ; s: | 259 |
| 4095596 | 56 | 0.888888889 | k: Bacteria; p: Proteobacteria; c: Betaproteobacteria; o: Burkholderiales; f: Alcaligenaceae; g: *Sutterella*; s: | 260 |
| 4120404 | 7 | 0.111111111 | k: Bacteria; p: Proteobacteria; c: Betaproteobacteria; o: Burkholderiales; f: Alcaligenaceae; g: *Sutterella*; s: | 261 |
| 4142052 | 1 | 0.015873016 | k: Bacteria; p: Proteobacteria; c: Betaproteobacteria; o: Burkholderiales; f: Alcaligenaceae; g: *Sutterella*; s: | 262 |
| 4217226 | 1 | 0.015873016 | k: Bacteria; p: Proteobacteria; c: Betaproteobacteria; o: Burkholderiales; f: Alcaligenaceae; g: *Sutterella*; s: | 263 |
| 4296764 | 3 | 0.047619048 | k: Bacteria; p: Firmicutes; c: Clostridia; o: Clostridiales; f: Christensenellaceae; g: ; s: | 264 |
| 4300127 | 3 | 0.047619048 | k: Bacteria; p: Firmicutes; c: Clostridia; o: Clostridiales; f: Veillonellaceae; g: ; s: | 265 |
| 4305261 | 2 | 0.031746032 | k: Bacteria; p: Firmicutes; c: Clostridia; o: Clostridiales; f: [Mogibacteriaceae]; g: ; s: | 266 |
| 4306356 | 56 | 0.888888889 | k: Bacteria; p: Actinobacteria; c: Actinobacteria; o: Actinomycetales; f: Actinomycetaceae; g: *Actinomyces*; s: | 267 |
| 4308647 | 32 | 0.507936508 | k: Bacteria; p: Actinobacteria; c: Actinobacteria; o: Actinomycetales; f: Actinomycetaceae; g: *Actinomyces*; s: | 268 |
| 4311621 | 7 | 0.111111111 | k: Bacteria; p: Firmicutes; c: Clostridia; o: Clostridiales; f: Veillonellaceae; g: *Phascolarctobacterium*; s: | 269 |
| 4317239 | 6 | 0.095238095 | k: Bacteria; p: Actinobacteria; c: Actinobacteria; o: Actinomycetales; f: Actinomycetaceae; g: ; s: | 270 |
| 4334479 | 36 | 0.571428571 | k: Bacteria; p: Actinobacteria; c: Actinobacteria; o: Actinomycetales; f: Actinomycetaceae; g: *Actinomyces*; s: | 271 |
| 4337970 | 3 | 0.047619048 | k: Bacteria; p: Bacteroidetes; c: Bacteroidia; o: Bacteroidales; f: [Barnesiellaceae]; g: ; s: | 272 |
| 4338624 | 7 | 0.111111111 | k: Bacteria; p: Proteobacteria; c: Betaproteobacteria; o: Burkholderiales; f: Alcaligenaceae; g: *Sutterella*; s: | 273 |
| 4338745 | 2 | 0.031746032 | k: Bacteria; p: Firmicutes; c: Clostridia; o: Clostridiales; f: Veillonellaceae; g: ; s: | 274 |
| 4341497 | 1 | 0.015873016 | k: Bacteria; p: Proteobacteria; c: Betaproteobacteria; o: Burkholderiales; f: Alcaligenaceae; g: *Sutterella*; s: | 275 |
| 4347860 | 1 | 0.015873016 | k: Bacteria; p: Actinobacteria; c: Actinobacteria; o: Actinomycetales; f: Actinomycetaceae; g: *Actinomyces*; s: | 276 |
| 4350499 | 10 | 0.158730159 | k: Bacteria; p: Actinobacteria; c: Actinobacteria; o: Actinomycetales; f: Actinomycetaceae; g: *Actinomyces*; s: | 277 |
| 4353658 | 2 | 0.031746032 | k: Bacteria; p: Firmicutes; c: Clostridia; o: Clostridiales; f: Veillonellaceae; g: *Phascolarctobacterium*; s: | 278 |
| 4355718 | 3 | 0.047619048 | k: Bacteria; p: Actinobacteria; c: Actinobacteria; o: Actinomycetales; f: Actinomycetaceae; g: *Actinomyces*; s: *hyovaginalis* | 279 |
| 4356080 | 13 | 0.206349206 | k: Bacteria; p: Bacteroidetes; c: Bacteroidia; o: Bacteroidales; f: [Barnesiellaceae]; g: ; s: | 280 |
| 4358599 | 1 | 0.015873016 | k: Bacteria; p: Bacteroidetes; c: Bacteroidia; o: Bacteroidales; f: S24-7; g: ; s: | 281 |
| 4366834 | 1 | 0.015873016 | k: Bacteria; p: Proteobacteria; c: Betaproteobacteria; o: Burkholderiales; f: Alcaligenaceae; g: *Sutterella*; s: | 282 |
| 4371341 | 6 | 0.095238095 | k: Bacteria; p: Firmicutes; c: Clostridia; o: Clostridiales; f: Veillonellaceae; g: *Phascolarctobacterium*; s: | 283 |
| 4371786 | 2 | 0.031746032 | k: Bacteria; p: Bacteroidetes; c: Bacteroidia; o: Bacteroidales; f: [Barnesiellaceae]; g: ; s: | 284 |
| 4377147 | 1 | 0.015873016 | k: Bacteria; p: Firmicutes; c: Clostridia; o: Clostridiales; f: Veillonellaceae; g: ; s: | 285 |

TABLE 5-continued

| Exemplary OTUs Useful in the Present Invention | | | | |
|---|---|---|---|---|
| A[1] | B | C | D[2] | E |
| 4391009 | 2 | 0.031746032 | k: Bacteria; p: Proteobacteria; c: Betaproteobacteria; o: Burkholderiales; f: Alcaligenaceae; g: *Sutterella*; s: | 286 |
| 4393396 | 8 | 0.126984127 | k: Bacteria; p: Bacteroidetes; c: Bacteroidia; o: Bacteroidales; f: [Barnesiellaceae]; g: ; s: | 287 |
| 4399767 | 1 | 0.015873016 | k: Bacteria; p: Actinobacteria; c: Actinobacteria; o: Actinomycetales; f: Actinomycetaceae; g: *Actinomyces*; s: | 288 |
| 4402605 | 1 | 0.015873016 | k: Bacteria; p: Firmicutes; c: Clostridia; o: Clostridiales; f: Christensenellaceae; g: ; s: | 289 |
| 4403574 | 1 | 0.015873016 | k: Bacteria; p: Actinobacteria; c: Actinobacteria; o: Actinomycetales; f: Actinomycetaceae; g: *Actinomyces*; s: | 290 |
| 4410097 | 1 | 0.015873016 | k: Bacteria; p: Firmicutes; c: Clostridia; o: Clostridiales; f: Christensenellaceae; g: ; s: | 291 |
| 4419621 | 1 | 0.015873016 | k: Bacteria; p: Proteobacteria; c: Betaproteobacteria; o: Burkholderiales; f: Alcaligenaceae; g: *Sutterella*; s: | 292 |
| 4424598 | 6 | 0.095238095 | k: Bacteria; p: Firmicutes; c: Clostridia; o: Clostridiales; f: Lachnospiraceae; g: *Lachnospira*; s: | 293 |
| 4429986 | 1 | 0.015873016 | k: Bacteria; p: Proteobacteria; c: Betaproteobacteria; o: Burkholderiales; f: Alcaligenaceae; g: *Sutterella*; s: | 294 |
| 4440335 | 1 | 0.015873016 | k: Bacteria; p: Firmicutes; c: Clostridia; o: Clostridiales; f: Christensenellaceae; g: ; s: | 295 |
| 4444790 | 6 | 0.095238095 | k: Bacteria; p: Firmicutes; c: Clostridia; o: Clostridiales; f: Veillonellaceae; g: *Phascolarctobacterium*; s: | 296 |
| 4445226 | 1 | 0.015873016 | k: Bacteria; p: Bacteroidetes; c: Bacteroidia; o: Bacteroidales; f: [Barnesiellaceae]; g: ; s: | 297 |
| 4449236 | 1 | 0.015873016 | k: Bacteria; p: Proteobacteria; c: Betaproteobacteria; o: Burkholderiales; f: Alcaligenaceae; g: *Sutterella*; s: | 298 |
| 4451901 | 1 | 0.015873016 | k: Bacteria; p: Firmicutes; c: Clostridia; o: Clostridiales; f: [Mogibacteriaceae]; g: ; s: | 299 |
| 4455005 | 1 | 0.015873016 | k: Bacteria; p: Firmicutes; c: Clostridia; o: Clostridiales; f: [Mogibacteriaceae]; g: ; s: | 300 |
| 4457427 | 44 | 0.698412698 | k: Bacteria; p: Firmicutes; c: Clostridia; o: Clostridiales; f: Lachnospiraceae; g: *Lachnospira*; s: | 301 |
| 4459196 | 3 | 0.047619048 | k: Bacteria; p: Firmicutes; c: Clostridia; o: Clostridiales; f: Lachnospiraceae; g: *Lachnospira*; s: | 302 |
| 4470870 | 2 | 0.031746032 | k: Bacteria; p: Bacteroidetes; c: Bacteroidia; o: Bacteroidales; f: [Barnesiellaceae]; g: ; s: | 303 |
| 4473506 | 5 | 0.079365079 | k: Bacteria; p: Proteobacteria; c: Betaproteobacteria; o: Burkholderiales; f: Alcaligenaceae; g: *Sutterella*; s: | 304 |
| 4474255 | 1 | 0.015873016 | k: Bacteria; p: Proteobacteria; c: Betaproteobacteria; o: Burkholderiales; f: Alcaligenaceae; g: *Sutterella*; s: | 305 |
| 4476561 | 12 | 0.19047619 | k: Bacteria; p: Bacteroidetes; c: Bacteroidia; o: Bacteroidales; f: [Barnesiellaceae]; g: ; s: | 306 |
| 4481613 | 2 | 0.031746032 | k: Bacteria; p: Actinobacteria; c: Coriobacteriia; o: Coriobacteriales; f: Coriobacteriaceae; g: *Collinsella*; s: *aerofaciens* | 307 |

[1]Operational taxonomic units (OTUs) which cluster bacteria based on 16S rRNA sequence identity.
[2]In this column, letters refer to phylogenetic classifications (e.g., "k:" refers to "kingdom," "p:" refers to phylum, and so on).

Table 6 lists exemplary bacterial genera and the number of OTUs identified in GreenGenes database (and recited in Table 5).

Columns:

A—Taxonomy for the genus

B— Number of OTUs that are found in healthy stool donors that belong to the genus C—SEQ ID Nos for the 16S rRNAs for OTUs in the genus

TABLE 6

| Exemplary Genera Useful in the Present Invention | | |
|---|---|---|
| A[3] | B | C |
| k__Bacteria; p__Firmicutes; c__Clostridia; o__Clostridiales; f__Veillonellaceae; g__ | 181 | 308-488 |
| k__Bacteria; p__Proteobacteria; c__Deltaproteobacteria; o__Desulfovibrionales; f__Desulfovibrionaceae; g__ | 19 | 489-507 |
| k__Bacteria; p__Firmicutes; c__Clostridia; o__Clostridiales; f__Veillonellaceae; g__*Phascolarctobacterium* | 28 | 508-535 |
| k__Bacteria; p__Firmicutes; c__Clostridia; o__Clostridiales; f__Lachnospiraceae; g__Lachnospira | 63 | 536-598 |
| k__Bacteria; p__Actinobacteria; c__Actinobacteria; o__Actinomycetales; f__Actinomycetaceae; g__*Actinomyces* | 41 | 599-639 |

TABLE 6-continued

| Exemplary Genera Useful in the Present Invention | | |
|---|---|---|
| A[3] | B | C |
| k__Bacteria; p__Proteobacteria; c__Betaproteobacteria; o__Burkholderiales; f__Alcaligenaceae; g__*Sutterella* | 37 | 640-676 |
| k__Bacteria; p__Firmicutes; c__Clostridia; o__Clostridiales; f__Christensenellaceae; g__ | 52 | 677-728 |
| k__Bacteria; p__Actinobacteria; c__Actinobacteria; o__Actinomycetales; f__Actinomycetaceae; g__ | 50 | 727-778 |
| k__Bacteria; p__Actinobacteria; c__Coriobacteriia; o__Coriobacteriales; f__Coriobacteriaceae; g__*Collinsella* | 26 | 779-804 |
| k__Bacteria; p__Firmicutes; c__Clostridia; o__Clostridiales; f__Mogibacteriaceae; g__ | 47 | 805-851 |
| k__Bacteria; p__Bacteroidetes; c__Bacteroidia; o__Bacteroidales; f__S24-7; g__ | 62 | 852-913 |
| k__Bacteria; p__Bacteroidetes; c__Bacteroidia; o__Bacteroidales; f__Barnesiellaceae; g__ | 31 | 914-944 |

[3] In this column, letters refer to phylogenetic classifications (e.g., "k" refers to "kingdom," "p" refers to phylum, and so on).

In an embodiment, a bacterial strain is included in the pharmaceutical composition of the invention based on its abundance in donors whose stool was used for successful or unsuccessful fecal microbiota transplants (FMTs) in a patient suffering from a gut dysbiosis disorder, e.g., caused by a previous or current anti-cancer therapy.

In an embodiment, a bacterial strain is included in the pharmaceutical composition of the invention based on its presence in the stool samples of donors whose stool was used for FMTs which provided a therapeutically effective result in a GI disorder patient.

In an embodiment, a bacterial strain is included in the pharmaceutical composition of the invention based on its ability to engraft in a recipient. For example, the recipient may be a FMT recipient who received stool transplant from a donor. The bacterial strain is considered to successfully engraft if the strain is abundant in donors and also increased in recipient patients compared to baseline pre-FMT. In some embodiments, the selected bacterial strain exhibits enhanced ability to colonize the mucosa, i.e., is a good mucosal colonizer.

In various embodiments, a bacterial strain may be selected for inclusion in the bacterial mixture based on its ability to directly inhibit a pathogenic bacterium through production of a secreted product.

In some embodiments, a bacterial strain may be selected for inclusion in the bacterial mixture based on its ability to help maintain and/or repair a deficient gut barrier.

In embodiments, a bacterial strain may be selected for inclusion in the bacterial mixture based on its ability to activate Toll-Like Receptors (TLRs), which modulate the production of antimicrobial peptides, which target many human bacterial pathogens.

In embodiments, a bacterial strain may be selected for inclusion in the bacterial mixture based on its ability to induce a thickening of the colonic epithelial mucus.

In embodiments, a bacterial strain may be selected for inclusion in the bacterial mixture based on its ability to induce an increase in IgA production.

In embodiments, a bacterial strain may be selected for inclusion in the bacterial mixture based on its ability to induce an increase in antimicrobial peptide production.

In embodiments, a bacterial strain may be selected for inclusion in the bacterial mixture based on its ability to induce improved tight junction integrity.

In embodiments, a bacterial strain may be selected for inclusion in the bacterial mixture based on its ability to produce Short-Chain Fatty Acid (SCFAs) or its ability to enhance production of SCFAs, which increases the thickness of the mucus layer, maintains the health of colonocytes, increases butyrate levels in the gut, inhibits nitric oxide synthase activity, reduces the concentration of host-derived nitrate levels in the gut, and/or induces IgA production. As used herein, SCFAs refer to fatty acids with an aliphatic tail of less than six carbon atoms. Illustrative SCFAs include, but are not limited to, formic acid, acetic acid, propionic acid, butyric acid, isobutyric acid, valeric acid, and isovaleric acid. Without wishing to be bound by theory, SCFAs are involved in mediation of GI inflammation, and SCFA-producing bacteria are associated with sustained clinical remission in UC. Accordingly, in some embodiments, a bacterial strain is selected based on its ability to produce increased levels of SCFAs. Additionally, in some embodiments, a bacterial strain is selected for its ability to complement the capacity of a functionally deficient microbial community (e.g., the microbial community of a patient infected and/or colonized by a pathogenic bacteria) to produce levels of SCFAs comparable to healthy individuals.

In an embodiment, a bacterial strain may be selected for inclusion in a bacterial mixture based on its ability to promote restoration of mucosal barrier functions. For example, in some embodiments, a bacterial strain may be selected based on its ability to enable mucosal healing, improve mucosal barrier function, and/or to reduce inflammation. Without wishing to be bound by theory, it is believed that inclusion of such bacterial strains reinforces both the structural and chemical barrier functions of the mucosa by displacing pathogenic mucus degrading microorganisms and support mucosal repair. In an embodiment, the inclusion of such bacterial strain impacts numerous inflammatory pathways linked to inappropriate microbial exposure.

Accordingly, in some embodiments, the pharmaceutical composition of the invention includes a bacterial strain that prevents and/or reduces the loss of mucus thickness associated with various GI disorders. In some embodiments, the pharmaceutical composition of the invention includes a bacterial strain that results in a reduction of bacterial penetration or bacterial load in the mucus. In some embodiments, the pharmaceutical composition of the invention includes a bacterial strain that reduces sulfate-reducing bacteria (SRB) in a subject.

Additional criteria that may be utilized for selecting a bacterial strain for inclusion in the pharmaceutical composition of the invention include, but are not limited to, the ability of the bacterial strain to inhibit IgA-degrading bacteria, the ability of the bacterial strain to inhibit serotonin-producing and serotonin-inducing bacteria, the ability of the bacterial strain to enhance tryptophan availability, the ability of the bacterial strain to produce anti-inflammatory zwitterionic polysaccharides, modification of signaling molecules interacting with the Aryl Hydrocarbon Receptor, and/or the ability of the bacterial strain to block the vitamin D receptor (VCD) or vitamin D signaling.

In various embodiments, individual bacterial strains are initially selected from Table 5 or Table 6 and subsequently pooled to form a mixture of bacterial strains. For example, in an embodiment, a mixture of bacterial strains may be formed by including one or more strains that has a 16S rRNA sequence that is at least about 97% identical with the 16S rRNA sequence of any one of the operational taxonomic units provided in Table 5 or Table 6, one or more bacterial strains that enhance the production of SCFAs, one or more strains that promote restoration and/or maintenance of the gut barrier.

In some embodiments, the mixtures of bacterial strains treat or prevent a diarrheal disease including, but not limited to, acute bloody diarrhea (e.g., dysentery), acute watery diarrhea (e.g., cholera), checkpoint inhibitor-associated colitis, diarrhea due to food poisoning, persistent diarrhea, and traveler's diarrhea.

In some embodiments, the mixtures of bacterial strains treat or prevent an IBD or related disease including, but not limited to, Crohn's disease, ulcerative colitis, collagenous colitis, lymphocytic colitis, diversion colitis, Behcet's disease, intermediate colitis, short bowel syndrome, ulcerative proctitis, pouchitis, proctosigmoiditis, left-sided colitis, pancolitis, and fulminant colitis.

In some embodiments, the mixtures of bacterial strains treat or prevent an autoimmune disorder including, but not limited to, acute disseminated encephalomyelitis (ADEM), acute necrotizing hemorrhagic leukoencephalitis, Addison's disease, agammaglobulinemia, alopecia areata, amyloidosis, ankylosing spondylitis, anti-GBM/anti-TBM nephritis, antiphospholipid syndrome (APS), autoimmune angioedema, autoimmune aplastic anemia, autoimmune dysautonomia, autoimmune hemolytic anemia, autoimmune hepatitis, autoimmune hyperlipidemia, autoimmune immunodeficiency, autoimmune inner ear disease (AIED), autoimmune myocarditis, autoimmune oophoritis, autoimmune pancreatitis, autoimmune retinopathy, autoimmune thrombocytopenic purpura (ATP), autoimmune thyroid disease, autoimmune urticarial, axonal & neuronal neuropathies, Balo disease, Behcet's disease, bullous pemphigoid, cardiomyopathy, Castleman disease, celiac disease, Chagas disease, chronic inflammatory demyelinating polyneuropathy (CIDP), chronic recurrent multifocal ostomyelitis (CRMO), Churg-Strauss syndrome, cicatricial pemphigoid/benign mucosal pemphigoid, Crohn's disease, Cogan's syndrome, cold agglutinin disease, congenital heart block, Coxsackie myocarditis, CREST disease, essential mixed cryoglobulinemia, demyelinating neuropathies, dermatitis herpetiformis, dermatomyositis, Devic's disease (neuromyelitis optica), discoid lupus, Dressler's syndrome, endometriosis, eosinophilic esophagitis, eosinophilic fasciitis, erythema nodosum, experimental allergic encephalomyelitis, Evans syndrome, fibrosing alveolitis, giant cell arteritis (temporal arteritis), giant cell myocarditis, glomerulonephritis, Goodpasture's syndrome, granulomatosis with polyangiitis (GPA), Graves' disease, Guillain-Barre syndrome, Hashimoto's encephalitis, Hashimoto's thyroiditis, hemolytic anemia, Henoch-Schonlein purpura, herpes gestationis, hypogammaglobulinemia, idiopathic thrombocytopenic purpura (ITP), IgA nephropathy, IgG4-related sclerosing disease, immunoregulatory lipoproteins, inclusion body myositis, interstitial cystitis, juvenile arthritis, juvenile idiopathic arthritis, juvenile myositis, Kawasaki syndrome, Lambert-Eaton syndrome, leukocytoclastic vasculitis, lichen planus, lichen sclerosus, ligneous conjunctivitis, linear IgA disease (LAD), lupus (systemic lupus erythematosus), chronic Lyme disease, Meniere's disease, microscopic polyangiitis, mixed connective tissue disease (MCTD), Mooren's ulcer, Mucha-Habermann disease, multiple sclerosis, myasthenia gravis, myositis, narcolepsy, neuromyelitis optica (Devic's), neutropenia, ocular cicatricial pemphigoid, optic neuritis, palindromic rheumatism, PANDAS (Pediatric Autoimmune Neuropsychiatric Disorders Associated with *Streptococcus*), paraneoplastic cerebellar degeneration, paroxysmal nocturnal hemoglobinuria (PNH), Parry Romberg syndrome, Parsonnage-Turner syndrome, pars planitis (peripheral uveitis), pemphigus, peripheral neuropathy, perivenous encephalomyelitis, pernicious anemia, POEMS syndrome, polyarteritis nodosa, type I, II, & III autoimmune polyglandular syndromes, polymyalgia rheumatic, polymyositis, postmyocardial infarction syndrome, postpericardiotomy syndrome, progesterone dermatitis, primary biliary cirrhosis, primary sclerosing cholangitis, psoriasis, psoriatic arthritis, idiopathic pulmonary fibrosis, pyoderma gangrenosum, pure red cell aplasia, Raynaud's phenomenon, reactive arthritis, reflex sympathetic dystrophy, Reiter's syndrome, relapsing polychondritis, restless legs syndrome, retroperitoneal fibrosis, rheumatic fever, rheumatoid arthritis, sarcoidosis, Schmidt syndrome, scleritis, scleroderma, Sjogren's syndrome, sperm and testicular autoimmunity, stiff person syndrome, subacute bacterial endocarditis (SBE), Susac's syndrome, sympathetic ophthalmia, Takayasu's arteritis, temporal arteritis/giant cell arteritis, thrombocytopenic purpura (TTP), Tolosa-Hunt syndrome, transverse myelitis, type 1 diabetes, asthma, ulcerative colitis, undifferentiated connective tissue disease (UCTD), uveitis, vasculitis, vesiculobullous dermatosis, vitiligo, and Wegener's granulomatosis.

In embodiments, the mixtures of bacterial strains treat or prevent diseases or disorders relating to the "gut-brain axis", including neurodegenerative, neurodevelopmental and neurocognitive disorders, such as anorexia, anxiety, autism-spectrum disorder, depression, Parkinson's, and Schizophrenia.

In embodiments, the mixtures of bacterial strains treat, prevent, or reduce a side effect of an anti-cancer therapy and/or increase efficacy of an anti-cancer therapeutic agent and/or anti-cancer therapy.

In embodiments, the anti-cancer therapy is surgery, radiation therapy, chemotherapy (including hormonal therapy) and/or targeted therapy (including an immunotherapy). Illustrative chemotherapeutics agents are provided elsewhere herein. In embodiments, the immunotherapy binds to and/or recognizes a tumor-cell antigen and/or a cancer-cell antigen, e.g., CTLA-4, PD-1, PD-L1, or PD-L2. In embodiments, the immunotherapy comprises administration of Keytruda (Pembrolizumab), Opdivo (Nivolumab), Yervoy (Ipilimumab), Tecentriq (atezolizumab), Bavencio (avelumab), and Imfinzi (durvalumab).

In embodiments, the subject, e.g., a human, is refractory and/or non-responsive to an anti-cancer therapy (as described herein). In embodiments, the pharmaceutical composition treats a subject that presents no response to the anti-cancer therapy, or even progress, after 12 weeks or so of receiving the anti-cancer therapy. Thus, a pharmaceutical composition of the present invention rescues subjects that are refractory and/or non-responsive to the anti-cancer therapy. In embodiments, the subject is refractory and/or non-responsive to a treatment directed to a checkpoint molecule, e.g., CTLA-4, PD-1, PD-L1, and/or PD-L2. In embodiments, the treatment directed to a checkpoint molecule comprises administration of Keytruda (Pembrolizumab), Opdivo (Nivolumab), Yervoy (Ipilimumab), Tecentriq (atezolizumab), Bavencio (avelumab), or Imfinzi (durvalumab).

Cancers or tumors refer to an uncontrolled growth of cells and/or abnormal increased cell survival and/or inhibition of apoptosis which interferes with the normal functioning of the bodily organs and systems. Included are benign and malignant cancers, polyps, hyperplasia, as well as dormant tumors or micrometastases. Also, included are cells having abnormal proliferation that is not impeded by the immune system (e.g., virus infected cells). The cancer may be a primary cancer or a metastatic cancer. The primary cancer may be an area of cancer cells at an originating site that becomes clinically detectable, and may be a primary tumor. In contrast, the metastatic cancer may be the spread of a disease from one organ or part to another non-adjacent organ or part. The metastatic cancer may be caused by a cancer cell that acquires the ability to penetrate and infiltrate surrounding normal tissues in a local area, forming a new tumor, which may be a local metastasis. The cancer may also be caused by a cancer cell that acquires the ability to penetrate the walls of lymphatic and/or blood vessels, after which the cancer cell is able to circulate through the bloodstream (thereby being a circulating tumor cell) to other sites and tissues in the body. The cancer may be due to a process such as lymphatic or hematogenous spread. The cancer may also be caused by a tumor cell that comes to rest at another site, re-penetrates through the vessel or walls, continues to multiply, and eventually forms another clinically detectable tumor. The cancer may be this new tumor, which may be a metastatic (or secondary) tumor.

The cancer may be caused by tumor cells that have metastasized, which may be a secondary or metastatic tumor. The cells of the tumor may be like those in the original tumor. As an example, if a breast cancer or colon cancer metastasizes to the liver, the secondary tumor, while present in the liver, is made up of abnormal breast or colon cells, not of abnormal liver cells. The tumor in the liver may thus be a metastatic breast cancer or a metastatic colon cancer, not liver cancer.

The cancer may have an origin from any tissue. The cancer may originate from melanoma, colon, breast, or prostate, and thus may be made up of cells that were originally skin, colon, breast, or prostate, respectively. The cancer may also be a hematological malignancy, which may be leukemia or lymphoma. The cancer may invade a tissue such as liver, lung, bladder, or intestinal.

Representative cancers and/or tumors of the present invention include, but are not limited to, a basal cell carcinoma, biliary tract cancer; bladder cancer; bone cancer; brain and central nervous system cancer; breast cancer (including Triple-Negative Breast Cancer); cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; urothelial carcinoma, vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (such as that associated with brain tumors), and Meigs' syndrome.

In various embodiments, the mixtures of bacterial strains may stimulate and/or activate Toll-like receptor activity (e.g., TLR1, and/or TLR2, and/or TLR3, and/or TLR4, and/or TLR5, and/or TLR6, and/or TLR7, and/or TLR8, and/or TLR9, and/or TLR10, and/or TLR11, and/or TLR12, and/or TLR13).

In some embodiments, the mixtures of bacterial strains treat or prevent the various GI disorders disclosed herein and/or as known in the art to be a result of gut dysbiosis.

In some embodiments the mixtures of bacterial strains reduce GI immunoactivation and inflammation.

In various embodiments, the mixtures of bacterial strains treat or prevent bloodstream infections (BSI). Patients at risk for such BSI include but are not limited to Solid organ transplant patients; Chronic kidney disease patients, e.g., on hemodialysis; and oncology patients.

The present invention is also useful for patients who are in an outpatient setting, hospitalized, or in long-term care facilities.

In various embodiments, the mixtures of bacterial strains treat or prevent various inflammatory disorders. Inflammatory disorders include but are not limited to Inflammatory bowel disease (Ulcerative colitis and Crohn's disease); Irritable bowel syndrome; Metabolic disease/Insulin resistance (Type II diabetes); and Rheumatoid arthritis.

In various embodiments, the mixture of bacterial strains includes one or more bacterial strains that interact synergistically for treating or preventing a herein-described disorder, disease, or disorder.

In some embodiments, the mixtures of bacterial strains reduce, ameliorate, or eliminate one or more symptom(s) associated with a herein-described disease, disorder, or condition. Exemplary symptoms include, but are not limited to, diarrhea, bloody stool, mouth sores, perianal disease, abdominal pain, abdominal cramping, fever, fatigue, weight loss, iron deficiency, anemia, appetite loss, weight loss, anorexia, delayed growth, delayed pubertal development, and inflammation of the skin, eyes, joints, liver, and bile ducts.

In some embodiments, the pharmaceutical composition of the invention comprises a bacterial strain derived from any one of the phylum, class, order, family, genus, and/or species listed in Table 5 or Table 6. In exemplary embodiments, the pharmaceutical composition of the invention comprises a bacterial strain belonging to the phylum Bacteroidetes or Firmicutes. In exemplary embodiments, the pharmaceutical composition of the invention comprises a bacterial strain belonging to the class Clostridia, Bacteroidia, or Bacilli. In exemplary embodiments, the pharmaceutical composition of the invention comprises a bacterial strain belonging to the order Bacteroidales, Clostridiales, or Lactobacillales. In exemplary embodiments, the pharmaceutical composition of the invention comprises a bacterial strain belonging to the family Bacteroidaceae, Ruminococcaceae, Lachnospiraceae, or Streptococcacea. In exemplary embodiments, the pharmaceutical composition of the invention comprises a bacterial strain belonging to the genus *Bacteroides, Blautia, Faecalibacterium, Coprococcus, Roseburia, Dorea, Clostridium, Eubacterium* or *Streptococcus*. In exemplary embodiments, the pharmaceutical composition of the invention comprises a bacterial strain belonging to the species *uniformis, prausnitzii*, or *faecis*.

Pharmaceutical Compositions, Formulations, and Administration

The present invention provides pharmaceutical compositions comprising the novel mixtures of bacterial strains (and/or additional therapeutic agents) in various formulations. Any pharmaceutical composition (and/or additional therapeutic agents) described herein can take the form of tablets, pills, pellets, capsules, capsules containing liquids, capsules containing multiparticulates, powders, solutions, emulsion, drops, suppositories, emulsions, aerosols, sprays, suspensions, delayed-release formulations, sustained-release formulations, controlled-release formulations, or any other form suitable for use.

The formulations comprising the pharmaceutical compositions (and/or additional therapeutic agents) may conveniently be presented in unit dosage forms. For example, the dosage forms may be prepared by methods which include the step of bringing the therapeutic agents into association with a carrier, which constitutes one or more accessory ingredients. For example, the formulations are prepared by uniformly and intimately bringing the therapeutic agent into association with a liquid carrier, a finely divided solid carrier, or both, and then, if necessary, shaping the product into dosage forms of the desired formulation (e.g., wet or dry granulation, powder blends, etc., followed by press tableting).

In one embodiment, the pharmaceutical compositions comprising the novel mixtures of bacterial strains (and/or additional therapeutic agents) described herein are formulated as a composition adapted for a mode of administration described herein.

In various embodiments, the administration of the pharmaceutical compositions (and/or additional therapeutic agents) is any one of oral, intravenous, intraperitoneal, and parenteral. For example, routes of administration include, but are not limited to, oral, intraperitoneal, intravenous, intramuscular, or rectally. In various embodiments, the administration of the pharmaceutical compositions (and/or additional therapeutic agents) is oral, naso-gastric, anterograde gastrointestinal, retrograde gastrointestinal, endoscopic, or enemic.

In one embodiment, the pharmaceutical compositions (and/or additional therapeutic agents) described herein is formulated as a composition adapted for oral administration. Compositions for oral delivery can be in the form of tablets, aqueous or oily suspensions, granules, powders, sprinkles, emulsions, or capsules as examples. Orally administered compositions can comprise one or more agents, for example, sweetening agents such as fructose, aspartame or saccharin; flavoring agents such as peppermint, oil of wintergreen, or cherry; coloring agents; perfuming agents, to mask an odor of a bacterial mixture; and preserving agents, to provide a pharmaceutically palatable preparation. Moreover, when in capsule, tablet, or pill form, the compositions can be coated to delay disintegration to provide a sustained action over an extended period of time. Selectively permeable membranes surrounding an osmotically active agent driving any microbial strain (and/or additional therapeutic agents) described herein are also suitable for orally administered compositions. In these latter platforms, fluid from the environment surrounding the capsule is imbibed by the driving compound, which swells to displace the agent or agent composition through an aperture. These delivery platforms can provide an essentially zero order delivery profile as opposed to the spiked profiles of immediate release formulations. A time-delay material such as glycerol monostearate or glycerol stearate can also be useful. Oral compositions can include standard excipients such as mannitol, lactose, starch, magnesium stearate, sodium saccharin, cellulose, ethacrylic acid and derivative polymers thereof, and magnesium carbonate. In one embodiment, the excipients are of pharmaceutical grade. Suspensions, in addition to the active compounds, may contain suspending agents such as, for example, ethoxylated isostearyl alcohols, polyoxyethylene sorbitol and sorbitan esters, microcrystalline cellulose, aluminum metahydroxide, bentonite, agar-agar, tragacanth, etc., and mixtures thereof.

Oral administration of the pharmaceutical compositions comprising bacterial mixtures, e.g., via a capsule, is preferable since this route is simpler and more convenient than more conventional, invasive techniques like enema, nasogastric tube, or colonoscopy.

In various embodiments, the pharmaceutical compositions (and/or additional therapeutic agent) are formulated as solid dosage forms such as tablets, dispersible powders, granules, and capsules. In one embodiment, the pharmaceutical compositions (and/or additional therapeutic agent) are formulated as a capsule. In another embodiment, the pharmaceutical compositions (and/or additional therapeutic agent) are formulated as a capsule or tablet. In yet another embodiment, the pharmaceutical compositions (and/or additional therapeutic agent) are formulated as a soft-gel capsule. In a further embodiment, the pharmaceutical compositions (and/or additional therapeutic agent) are formulated as a gelatin capsule.

Dosage forms suitable for parenteral administration (e.g., intravenous, intramuscular, or intraperitoneal injection and infusion) include, for example, solutions, suspensions, dispersions, emulsions, and the like. They may also be manufactured in the form of sterile solid compositions (e.g., lyophilized composition), which can be dissolved or suspended in sterile injectable medium immediately before use. They may contain, for example, suspending or dispersing agents.

In various embodiments, the formulations of the invention may additionally comprise a pharmaceutically acceptable carrier or excipient. As one skilled in the art will recognize, the formulations can be in any suitable form appropriate for the desired use and route of administration.

In some dosage forms, the agents described herein can be mixed with at least one inert, pharmaceutically acceptable excipient or carrier such as sodium citrate, dicalcium phosphate, and/or (a) fillers or extenders such as starches, lactose, sucrose, glucose, mannitol, silicic acid, microcrystalline cellulose, and Bakers Special Sugar, (b) binders such as, for example, carboxymethylcellulose, alginates, gelatin, polyvinylpyrrolidone, sucrose, acacia, polyvinyl alcohol, polyvinylpyrrolidone, methylcellulose, hydroxypropyl cellulose (HPC), and hydroxymethyl cellulose etc., (c) humectants such as glycerol, (d) disintegrating agents such as agar-agar, calcium carbonate, potato or tapioca starch, alginic acid, certain silicates, sodium carbonate, cross-linked polymers such as crospovidone (cross-linked polyvinylpyrrolidone), croscarmellose sodium (cross-linked sodium carboxymethylcellulose), sodium starch glycolate, (e) solution retarding agents such as paraffin, (f) absorption accelerators such as quaternary ammonium compounds, (g) wetting agents such as, for example, cetyl alcohol and glycerol monostearate, (h) absorbents such as kaolin and bentonite clay, and (i) lubricants such as talc, calcium stearate, magnesium stearate, solid polyethylene glycols, sodium lauryl sulfate, glyceryl behenate, and mixtures of such excipients. One of skill in the art will recognize that particular excipients may have two or more functions in the oral dosage form. In the case of an oral dosage form, for example, a capsule or a tablet, the dosage form may also comprise buffering agents.

The formulation can additionally include a surface active agent. Surface active agents suitable for use in the present invention include, but are not limited to, any pharmaceutically acceptable, non-toxic surfactant. Classes of surfactants suitable for use in the compositions of the invention include, but are not limited to polyethoxylated fatty acids, PEG-fatty acid diesters, PEG-fatty acid mono- and di-ester mixtures, polyethylene glycol glycerol fatty acid esters, alcohol-oil transesterification products, polyglycerized fatty acids, propylene glycol fatty acid esters, mixtures of propylene glycol esters-glycerol esters, mono- and diglycerides, sterol and sterol derivatives, polyethylene glycol sorbitan fatty acid esters, polyethylene glycol alkyl ethers, sugar esters, polyethylene glycol alkyl phenols, polyoxyethylene-olyoxypropylene block copolymers, sorbitan fatty acid esters, lower alcohol fatty acid esters, ionic surfactants, and mixtures thereof. In some embodiments, compositions of the invention may comprise one or more surfactants including, but not limited to, sodium lauryl sulfate, polysorbate 20, polysorbate 40, polysorbate 60, polysorbate 80, and triethyl citrate.

The formulation can also contain pharmaceutically acceptable plasticizers to obtain the desired mechanical properties such as flexibility and hardness. Such plasticizers include, but are not limited to, triacetin, citric acid esters, triethyl citrate, phthalic acid esters, dibutyl sebacate, cetyl alcohol, polyethylene glycols, polysorbates or other plasticizers.

The formulation can also include one or more application solvents. Some of the more common solvents that can be used to apply, for example, a delayed-release coating composition include isopropyl alcohol, acetone, methylene chloride and the like.

The formulation can also include one or more alkaline materials. Alkaline material suitable for use in compositions of the invention include, but are not limited to, sodium, potassium, calcium, magnesium and aluminum salts of acids such as phosphoric acid, carbonic acid, citric acid and other aluminum/magnesium compounds. In addition, the alkaline material may be selected from antacid materials such as aluminum hydroxides, calcium hydroxides, magnesium hydroxides and magnesium oxide.

In various embodiments, the pharmaceutical compositions (and/or additional therapeutic agents) are formulated for systemic or local delivery. In an embodiment, administration is systemic. In another embodiment, it may be desirable to administer locally to the area in need of treatment.

Various methods may be used to formulate and/or deliver the agents described herein to alocation of interest. For example, the pharmaceutical compositions (and/or additional therapeutic agents) described herein may be formulated for delivery to the GI tract. The GI tract includes organs of the digestive system such as mouth, esophagus, stomach, duodenum, small intestine, large intestine (also referred here to as the "colon") and rectum and includes all subsections thereof (e.g., the small intestine may include the duodenum, jejunum and ileum; the large intestine may include the colon transversum, colon descendens, colon ascendens, colon sigmoidenum and cecum). For example, the bacterial strains and/or pharmaceutical compositions (and/or additional therapeutic agents) described herein may be formulated for delivery to one or more of the stomach, small intestine, large intestine and rectum and includes all subsections thereof (e.g., duodenum, jejunum and ileum, colon transversum, colon descendens, colon ascendens, colon sigmoidenum and cecum). In some embodiments, the compositions described herein may be formulated to deliver to the upper or lower GI tract. In an embodiment, the bacterial strains and/or pharmaceutical compositions (and/or additional therapeutic agents) may be administered to a subject, by, for example, directly or indirectly contacting the mucosal tissues of the GI tract.

In various embodiments, the administration the pharmaceutical compositions (and/or additional therapeutic agents) is into the GI tract via, for example, oral delivery, nasogastral tube, intestinal intubation (e.g., an enteral tube or feeding tube such as, for example, a jejunal tube or gastro-jejunal tube, etc.), direct infusion (e.g., duodenal infusion), endoscopy, colonoscopy, or enema.

For example, in various embodiments, the present invention provides modified-release formulations comprising the novel mixtures of bacterial strains (and/or additional therapeutic agents), wherein the formulation releases a substantial amount of the bacterial strains (and/or additional therapeutic agents) into one or more regions of the GI tract. For example, the formulation may release at least about 60% of the bacterial strains after the stomach and into one or more regions of the GI tract.

In various embodiments, the modified-release formulation of the present invention releases at least 60% of the bacterial strains (or additional therapeutic agents) after the stomach into one or more regions of the intestine. For example, the modified-release formulation releases at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% of the bacterial strains (or additional therapeutic agents) in the intestines.

In various embodiments, the modified-release formulation of the present invention releases at least 60% of the bacterial strains (or additional therapeutic agents) in the small intestine. For example, the modified-release formulation releases at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% of the bacterial strains (or additional therapeutic agents) in the small intestine (e.g., one or more of duodenum, jejunum, ileum, and ileocecal junction).

In various embodiments, the modified-release formulation of the present invention releases at least 60% of the bacterial strains (or additional therapeutic agents) in the large intestine. For example, the modified-release formulation releases at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% of the bacterial strains (or additional therapeutic agents) in the large intestine (e.g., one or more of cecum, ascending, transverse, descending or sigmoid portions of the colon, and rectum).

In various embodiments, the pharmaceutical composition is formulated for substantially complete delivery prior to the rectum.

In some embodiments, the pharmaceutical composition is formulated for release in the stomach (e.g., so-called reverse enteric formulations). In other embodiments, the pharmaceutical composition is formulated so as to not substantially release the bacterial strains in the stomach.

In certain embodiments, the modified-release formulation releases the bacterial strains (or additional therapeutic agents) at a specific pH. For example, in some embodiments, the modified-release formulation is substantially stable in an acidic environment and substantially unstable (e.g., dissolves rapidly or is physically unstable) in a near neutral to alkaline environment. In some embodiments, stability is indicative of not substantially releasing while instability is indicative of substantially releasing. For example, in some embodiments, the modified-release formulation is substantially stable at a pH of about 7.0 or less, or about 6.5 or less, or about 6.0 or less, or about 5.5 or less, or about 5.0 or less, or about 4.5 or less, or about 4.0 or less, or about 3.5 or less, or about 3.0 or less, or about 2.5 or less, or about 2.0 or less, or about 1.5 or less, or about 1.0 or less. In some embodiments, the present formulations are stable in lower pH areas and therefore do not substantially release in, for example, the stomach. In some embodiments, modified-release formulation is substantially stable at a pH of about 1 to about 4 or lower and substantially unstable at pH values that are greater. In these embodiments, the modified-release formulation does not substantially release in the stomach. In these embodiments, the modified-release formulation substantially releases in the small intestine (e.g., one or more of the duodenum, jejunum, and ileum) and/or large intestine (e.g., one or more of the cecum, ascending colon, transverse colon, descending colon, and sigmoid colon). In some embodiments, modified-release formulation is substantially stable at a pH of about 4 to about 5 or lower and consequentially is substantially unstable at pH values that are greater and therefore is not substantially released in the stomach and/or small intestine (e.g., one or more of the duodenum, jejunum, and ileum). In these embodiments, the modified-release formulation substantially releases in the large intestine (e.g., one or more of the cecum, ascending colon, transverse colon, descending colon, and sigmoid colon). In various embodiments, the pH values recited herein may be adjusted as known in the art to account for the state of the subject, e.g., whether in a fasting or postprandial state.

In some embodiments, the modified-release formulation is substantially stable in gastric fluid and substantially unstable in intestinal fluid and, accordingly, is substantially released in the small intestine (e.g., one or more of the duodenum, jejunum, and ileum) and/or large intestine (e.g., one or more of the cecum, ascending colon, transverse colon, descending colon, and sigmoid colon).

In some embodiments, the modified-release formulation is stable in gastric fluid or stable in acidic environments. These modified-release formulations release about 30% or less by weight of the bacterial strains and/or additional therapeutic agent in the modified-release formulation in gastric fluid with a pH of about 4 to about 5 or less, or simulated gastric fluid with a pH of about 4 to about 5 or less, in about 15, or about 30, or about 45, or about 60, or about 90 minutes. Modified-release formulations of the of the invention may release from about 0% to about 30%, from about 0% to about 25%, from about 0% to about 20%, from about 0% to about 15%, from about 0% to about 10%, about 5% to about 30%, from about 5% to about 25%, from about 5% to about 20%, from about 5% to about 15%, from about 5% to about 10% by weight of the bacterial strains and/or additional therapeutic agent in the modified-release formulation in gastric fluid with a pH of 4-5, or less or simulated gastric fluid with a pH of 4-5 or less, in about 15, or about 30, or about 45, or about 60, or about 90 minutes. Modified-release formulations of the invention may release about 1%, about 2%, about 3%, about 4%, about 5%, about 6%, about 7%, about 8%, about 9%, or about 10% by weight of the total bacterial strains and/or additional therapeutic agent in the modified-release formulation in gastric fluid with a pH of 5 or less, or simulated gastric fluid with a pH of 5 or less, in about 15, or about 30, or about 45, or about 60, or about 90 minutes.

In some embodiments, the modified-release formulation is unstable in intestinal fluid. These modified-release formulations release about 70% or more by weight of the bacterial strains and/or additional therapeutic agent in the modified-release formulation in intestinal fluid or simulated intestinal fluid in about 15, or about 30, or about 45, or about 60, or about 90 minutes. In some embodiments, the modified-release formulation is unstable in near neutral to alkaline environments. These modified-release formulations release about 70% or more by weight of the bacterial strains and/or additional therapeutic agent in the modified-release formulation in intestinal fluid with a pH of about 4-5 or greater, or simulated intestinal fluid with a pH of about 4-5 or greater, in about 15, or about 30, or about 45, or about 60, or about 90 minutes. A modified-release formulation that is unstable in near neutral or alkaline environments may release 70% or more by weight of bacterial strains and/or additional therapeutic agent in the modified-release formulation in a fluid having a pH greater than about 5 (e.g., a fluid having a pH of from about 5 to about 14, from about 6 to about 14, from about 7 to about 14, from about 8 to about 14, from about 9 to about 14, from about 10 to about 14, or from about 11 to about 14) in from about 5 minutes to about 90 minutes, or from about 10 minutes to about 90 minutes, or from about 15 minutes to about 90 minutes, or from about 20 minutes to about 90 minutes, or from about 25 minutes to about 90 minutes, or from about 30 minutes to about 90 minutes, or from about 5 minutes to about 60 minutes, or from about 10 minutes to about 60 minutes, or from about 15 minutes to about 60 minutes, or from about 20 minutes to about 60 minutes, or from about 25 minutes to about 90 minutes, or from about 30 minutes to about 60 minutes.

Examples of simulated gastric fluid and simulated intestinal fluid include, but are not limited to, those disclosed in the 2005 Pharmacopeia 23NF/28USP in Test Solutions at page 2858 and/or other simulated gastric fluids and simulated intestinal fluids known to those of skill in the art, for example, simulated gastric fluid and/or intestinal fluid prepared without enzymes.

In various embodiments, the modified-release formulation of the invention is substantially stable in chyme. For example, there is, in some embodiments, a loss of less about 50% or about 40%, or about 30%, or about 20%, or about 10% of bacterial strains activity in about 10, or 9, or 8, or 7, or 6, or 5, or 4, or 3, or 2, or 1 hour from administration.

In various embodiments, the modified-release formulations of the present invention are designed for immediate release (e.g., upon ingestion). In various embodiments, the modified-release formulations may have sustained-release profiles, i.e., slow release of the active ingredient(s) in the body (e.g., GI tract) over an extended period of time. In various embodiments, the modified-release formulations may have a delayed-release profile, i.e., not immediately release the active ingredient(s) upon ingestion; rather, postponement of the release of the active ingredient(s) until the composition is lower in the GI tract; for example, for release in the small intestine (e.g., one or more of duodenum, jejunum, ileum) or the large intestine (e.g., one or more of cecum, ascending, transverse, descending or sigmoid portions of the colon, and rectum). For example, a composition can be enteric coated to delay release of the active ingredient(s) until it reaches the small intestine or large intestine.

In various embodiments, the modified-release formulation of the present invention may utilize one or more modified-release coatings such as delayed-release coatings to provide for effective, delayed yet substantial delivery of the bacterial strains to the GI tract together with, optionally, additional therapeutic agents.

In one embodiment, the delayed-release coating includes an enteric agent that is substantially stable in acidic environments and substantially unstable in near neutral to alkaline environments. In an embodiment, the delayed-release coating contains an enteric agent that is substantially stable in gastric fluid. The enteric agent can be selected from, for example, solutions or dispersions of methacrylic acid copolymers, cellulose acetate phthalate (CAP), hydroxypropylmethyl cellulose phthalate, polyvinyl acetate phthalate, carboxymethylethylcellulose, and EUDRAGIT®-type polymer (poly(methacrylic acid, methylmethacrylate), hydroxypropyl methylcellulose acetate succinate, cellulose acetate trimellitate, hypromellose (INN) hydroxypropyl methylcellulose (HPMC), shellac or other suitable enteric coating polymers. Similar polymers include Kollicoat® MAE 30 DP and Kollicoat® MAE 100 P. In various embodiments, the enteric agent may be a combination of the foregoing solutions or dispersions. In embodiments, the enteric agent comprises any EUDRAGIT®-type polymer, derivatives thereof, and copolymers thereof. EUDRAGIT® polymers are available from Evonik Industries AG (Essen, Germany).

In certain embodiments, one or more coating system additives are used with the enteric agent. For example, one or more PasACRYL™ additives may be used as an anti-tacking agent coating additive. Illustrative PasACRYL™ additives include, but are not limited to PasACRYL™ HTP20 and PasACRYL™ T20.

In another embodiment, the delayed-release coating may degrade as a function of time when in aqueous solution without regard to the pH and/or presence of enzymes in the solution. Such a coating may comprise a water insoluble polymer. Its solubility in aqueous solution is therefore independent of the pH. The term "pH independent" as used herein means that the water permeability of the polymer and its ability to release pharmaceutical ingredients is not a function of pH and/or is only very slightly dependent on pH. Such coatings may be used to prepare, for example, sustained release formulations. Suitable water insoluble polymers include pharmaceutically acceptable non-toxic polymers that are substantially insoluble in aqueous media, e.g., water, independent of the pH of the solution. Suitable polymers include, but are not limited to, cellulose ethers, cellulose esters, or cellulose ether-esters, i.e., a cellulose derivative in which some of the hydroxy groups on the cellulose skeleton are substituted with alkyl groups and some are modified with alkanoyl groups. Examples include ethyl cellulose, acetyl cellulose, nitrocellulose, and the like. Other examples of insoluble polymers include, but are not limited to, lacquer, and acrylic and/or methacrylic ester polymers, polymers or copolymers of acrylate or methacrylate having a low quaternary ammonium content, or mixture thereof and the like. Other examples of insoluble polymers include EUDRAGIT RS®, EUDRAGIT RL®, and EUDRAGIT NE®. Insoluble polymers useful in the present invention include polyvinyl esters, polyvinyl acetals, polyacrylic acid esters, butadiene styrene copolymers, and the like. In one embodiment, colonic delivery is achieved by use of a slowly-eroding wax plug (e.g., various PEGS, including for example, PEG6000).

In some embodiments, an enteric (interior or exterior) coating comprises a polymeric material. Non-limiting examples of suitable polymeric materials include polymethylmethacrylate, poly(N,N-dimethylacrylamide), polyoxamer, polyethylene glycol, polypropylene glycol, polysaccharides (e.g., sucrose, trehalose, glucose, starches such as tapioca and arrowroot, chitosan, alginate, guar gum), polyacrylate, polymethacrylate, polyvinyl alcohol, polyalkylene glycols, polyacrylamide, polyvinylpyrrolidone, polyurethane, polylactide, lactide/glycolide copolymer, polycaprolactone, polydioxanones, polyanhydride, polyhydroxybutyrate, polysiloxane, polytrimethylene carbonate, polyalkylene glycol, and combinations and/or copolymers thereof.

In a further embodiment, the delayed-release coating may be degraded by a microbial enzyme present in the gut flora. In one embodiment, the delayed-release coating may be degraded by a bacteria present in the small intestine. In another embodiment, the delayed-release coating may be degraded by a bacteria present in the large intestine.

Such a coating may comprise a mixture of a first material which is susceptible to attack by colonic bacteria and a second material which has a solubility threshold at about pH 5 or above. The first material may comprise a polysaccharide selected from starch, amylose, amylopectin, chitosan, chondroitin sulfate, cyclodextrin, dextran, pullulan, carrageenan, scleroglucan, chitin, curdulan, and levan. The second material may dissolve in a pH-dependent manner such that it has a "pH threshold" which is the pH below which it is insoluble and at or above which it is soluble. The pH of the surrounding medium triggers dissolution of the second material; thus, little of the second material dissolves below the pH threshold. Once the pH of the surrounding medium reaches (or exceeds) the pH threshold, the second material becomes soluble. In embodiments, the surrounding medium means the medium in the GI tract, such as the gastric juice or intestinal juice or the in vitro equivalent of the medium in the GI tract. The second material may be a film-forming polymeric material such as an acrylate polymer, a cellulose polymer or a polyvinyl-based polymer. Examples of suitable cellulose polymers include cellulose acetate phthalate ("CAP"), cellulose acetate trimellitate ("CAT"), and hydropropylmethylcellulose acetate succinate. Examples of suitable polyvinyl-based polymers include polyvinyl acetate phthalate ("PVAP"). The second material may be a co-polymer of a (meth)acrylic acid and a (meth)acrylic acid C1-4 alkyl ester, for instance, a copolymer of methacrylic acid and methacrylic acid methyl ester. Such a polymer is known as a poly(methacrylic acid/methyl methacrylate) co-polymer. Examples of such co-polymers are usually anionic and not sustained release polymethacrylates. Examples of anionic poly(methacrylic acid/methyl methacrylate) co-polymers include Eudragit® L, Eudragit® S, and Eudragit® FS. The coating may have an additional layer either between the bacterial mixture core and the layer comprising the delayed release composition described above and/or an outer layer coating the delayed release composition layer as described above.

In embodiments, a capsule comprises an interior enteric coating which has hydrophobic properties which prevents or retards the contact of an aqueous phase (e.g., a drug substance of the present disclosure) with the capsule (or capsule material). In embodiments, the interior enteric coating comprises a hydrophobic coating. The hydrophobic coating may comprise a material selected from the group consisting of shellac, zein, polysaccharides, silk, polycaprolactone, oil, pectin, wax, polymers, shellac, and derivatives thereof, and combinations thereof. Non-limiting examples of suitable polysaccharides include alginate, hyaluronic acid, and chitosan. Non-limiting examples of suitable oils include avocado oil, vegetable oil, castor oil, olive oil, jojoba oil, cocoa butter, coconut oil. Non-limiting examples of suitable waxes include beeswax, carnauba wax, and paraffin wax. In some embodiments, the hydrophobic coating is shellac.

An interior enteric coating may be selected and designed such that it protects the capsule (or capsule material) from an aqueous phase. For example, in some embodiments, the interior enteric coating prevents the aqueous phase (e.g., a mixture of bacterial strains of the present disclosure) from contacting the capsule and/or such that the capsule material is not degraded and/or dissolved by the aqueous phase. In some embodiments, the interior enteric coating protects the capsule from the aqueous phase for greater than or equal to 1 day, greater than or equal to 2 days, greater than or equal to 3 days, greater than or equal to 7 days, greater than or equal to 14 days, greater than or equal to 30 days, greater than or equal to 90 days, or greater than or equal to 180 days at room temperature under ambient conditions. In certain embodiments, the interior enteric coating protects the capsule from the aqueous phase for less than or equal to 365 days, less than or equal to 180 days, less than or equal to 90 days, less than or equal to 30 days, less than or equal to 14 days, less than or equal to 7 days, less than or equal to 3 days, or less than or equal to 2 days at room temperature under ambient conditions. Combinations of the above-referenced ranges are possible (e.g., greater than or equal to 1 day and less than or equal to 365 days). Other ranges are also possible. As such, in some embodiments, the capsule is stable at room temperature under ambient conditions for the times listed above (e.g., greater than or equal to 1 day).

In certain embodiments, the interior enteric coating protects the capsule from the aqueous phase (e.g., the interior enteric coating prevents the aqueous phase from contacting the capsule and/or such that the capsule material is not degraded and/or dissolved by the aqueous phase) for greater than or equal to 1 hour, greater than or equal to 2 hours, greater than or equal to 3 hours, greater than or equal to 6 hours, greater than or equal to 12 hours, greater than or equal to 18 hours, greater than or equal to 24 hours, greater than or equal to 48 hours, or greater than or equal to 96 hours at 37° C. In certain embodiments, the interior enteric coating protects the capsule from the aqueous phase for less than or equal to 168 hours, less than or equal to 96 hours, less than or equal to 48 hours, less than or equal to 24 hours, less than or equal to 18 hours, less than or equal to 12 hours, less than or equal to 6 hours, less than or equal to 3 hours, or less than or equal to 2 hours at 37° C. under ambient conditions. Combinations of the above-referenced ranges are possible (e.g., greater than or equal to 1 hour and less than or equal to 168 hours). As such, in certain embodiments, the capsule is stable at 37° C. under ambient conditions for the times listed above (e.g., greater than or equal to 1 hour).

In various embodiments, the modified release formulation is designed for release in the colon. Various colon-specific delivery approaches may be utilized. For example, the modified release formulation may be formulated using a colon-specific drug delivery system (CODES) as described for example, in Li et al., AAPS PharmSciTech (2002), 3(4): 1-9, the entire contents of which are incorporated herein by reference. Drug release in such a system is triggered by colonic microflora coupled with pH-sensitive polymer coatings. For example, the formulation may be designed as a core tablet with three layers of polymer. The first coating is an acid-soluble polymer (e.g., EUDRAGIT E), the outer coating is enteric, along with a hydroxypropyl methylcellulose barrier layer interposed in between. In another embodiment, colon delivery may be achieved by formulating the bacterial strains (and/or additional therapeutic agent) with specific polymers that degrade in the colon such as, for example, pectin. The pectin may be further gelled or crosslinked with a cation such as a zinc cation. In an embodiment, the formulation is in the form of ionically crosslinked pectin beads which are further coated with a polymer (e.g., EUDRAGIT polymer). Additional colon specific formulations include, but are not limited to, pressure-controlled drug delivery systems (prepared with, for example, ethylcellulose) and osmotic controlled drug delivery systems (i.e., ORDS-CT).

In some embodiments, an enteric (interior or exterior) coating comprises an enteric elastomer. In some embodiments, the enteric elastomer comprises a mixture of two or more polymers with carboxyl functionality such that the two or more polymers form hydrogen bonds with one another and has both enteric and elastic properties. In certain embodiments, the enteric elastomer comprises a first polymer comprising a structure as in Formula (I):

(I)

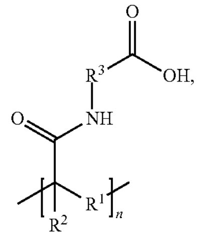

or a pharmaceutically acceptable salt thereof, wherein each $R^1$ is the same or different and is selected from the group consisting of optionally substituted alkylene, optionally substituted heteroalkylene, optionally substituted arylene, and optionally substituted heteroarylene, each $R^2$ is the same or different and is selected from the group consisting of hydrogen, optionally substituted alkyl, and optionally substituted heteroalkyl, each $R^3$ is the same or different and is selected from the group consisting of optionally substituted alkylene and optionally substituted heteroalkylene, n is an integer between 25 and 250,000, and a second polymer comprising a structure as in Formula (II) hydrogen bonded to the first polymer:

(II)

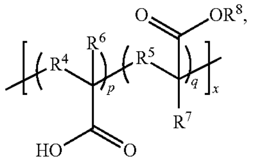

or a pharmaceutically acceptable salt thereof, wherein each $R^4$ is the same or different and is selected from the group consisting of optionally substituted alkylene and optionally substituted heteroalkylene, each $R^5$ is the same or different and is selected from the group consisting of optionally substituted alkylene and optionally substituted heteroalkylene, each $R^6$ is the same or different and is selected from the group consisting of hydrogen, optionally substituted alkyl, and optionally substituted heteroalkyl, each $R^7$ is the same or different and is selected from the group consisting of hydrogen, optionally substituted alkyl, and optionally substituted heteroalkyl, each $R^8$ is the same or different and is optionally substituted alkyl, p is an integer between 1 and 10, q is an integer between 1 and 10, and z is an integer between 1 and 150,000, provided that (p+q)*z is greater than or equal to 20. Suitable enteric elastomers and methods for making such enteric elastomers are described in more detail in International Patent Publication No. WO2015191922, which is incorporated herein by reference in its entirety for all purposes.

In some embodiments, a capsule comprises a polymeric material. Non-limiting examples of suitable polymeric materials include gelatin, polymethylmethacrylate, poly(N,N-dimethylacrylamide), polyoxamer, polyethylene glycol, polypropylene glycol, polysaccharides (e.g., sucrose, trehalose, glucose, starches such as tapioca and arrowroot, chitosan, alginate, guar gum), polyacrylate, polymethacrylate, polyvinyl alcohol, polyalkylene glycols, polyacrylamide, polyvinylpyrrolidone, polyurethane, polylactide, lactide/glycolide copolymer, polycaprolactone, polydioxanones, polyanhydride, polyhydroxybutyrate, polysiloxane, polytrimethylene carbonate, polyalkylene glycol, and combinations and/or copolymers thereof. In embodiments, the capsule comprises gelatin.

In certain embodiments, the capsule may comprise a bioadherent polymer such as mucin.

Embodiments of dual-coated coated capsules are disclosed in WO2018057747, the contents of which are incorporated by reference in their entirety.

In certain embodiments, the capsule has a particular shape or size. For example, in some cases, the capsule has a shape or size as described in the USP including, but not limited to, #000 capsule, #00 capsule, #0 capsule, #1 capsule, #2 capsule, #3 capsule, #4 capsule, or #5 capsule. Other capsule shapes and/or sizes are also possible. Formulations for colon specific delivery of the bacterial strains (and/or additional therapeutic agents), as described herein, may be evaluated using, for example, in vitro dissolution tests. For example, parallel dissolution studies in different buffers may be undertaken to characterize the behavior of the formulations at different pH levels. Alternatively, in vitro enzymatic tests may be carried out. For example, the formulations may be incubated in fermenters containing suitable medium for bacteria, and the amount of drug released at different time intervals is determined. Drug release studies can also be done in buffer medium containing enzymes or rat or guinea pig or rabbit cecal contents and the amount of drug released in a particular time is determined. In a further embodiment, in vivo evaluations may be carried out using animal models such as dogs, guinea pigs, rats, and pigs. Further, clinical evaluation of colon specific drug delivery formulations may be evaluated by calculating drug delivery index (DDI) which considers the relative ratio of RCE (relative colonic tissue exposure to the drug) to RSC (relative amount of drug in blood i.e., that is relative systemic exposure to the drug). Higher drug DDI indicates better colon drug delivery. Absorption of drugs from the colon may be monitored by colonoscopy and intubation.

In various embodiments, the present formulation provides for substantial uniform dissolution of the bacterial strains (and/or additional therapeutic agent) in the area of release in the GI tract. In an embodiment, the present formulation minimizes patchy or heterogeneous release of the bacterial strains.

In various embodiments, the present formulations provide for release of multiple doses of the bacterial strains along the GI tract. For example, the composition and/or formulation can release multiple doses of the bacterial strains at different locations along the intestines, at different times, and/or at different pH. The overall release profile of such a formulation may be adjusted using, for example, multiple particle types or multiple layers. For example, in one embodiment, the first dose of the bacterial strains may be formulated for release in, for example, the small intestine (e.g., one or more of duodenum, jejunum, ileum), whereas the second dose is formulated for delayed release in, for example, the large intestines (e.g., one or more of cecum, ascending, transverse, descending or sigmoid portions of the colon, and rectum). In another example, the first dose of the bacterial strains may be formulated for release in, for example, the small intestine (e.g., one or more of duodenum, jejunum, ileum), whereas the second dose is formulated for delayed release in, for example, another part of the small intestine (e.g., one or more of duodenum, jejunum, ileum). In another embodiment, the first dose of the bacterial strains may be formulated for release in, for example, the large intestine (e.g., one or more of cecum, ascending, transverse, descending or sigmoid portions of the colon, and rectum), whereas the second dose is formulated for delayed release in, for example, another part of the large intestine (e.g., one or more of cecum, ascending, transverse, descending or sigmoid portions of the colon, and rectum). In various embodiments, the composition and/or formulation may release at least one dose, at least two doses, at least three doses, at least four doses, or at least five doses of the bacterial strains at different locations along the intestines, at different times, and/or at different pH.

In some embodiments, the bacterial strains described herein are in the form of live, vegetative cells. In some embodiments, the bacterial strains described herein are in the form of spores. In some embodiments, the bacterial strains described herewith are lyophilized. As used herein, "lyophilization" or "freeze drying" refers to the process of drying a material by first freezing it and then encouraging the ice within it to sublimate in a vacuum environment. By way of non-limiting example, lyophilization can be via methods known in the art, including those described in U.S. Pat. No. 7,799,328, the contents of which are hereby incorporated by reference in their entirety. In some embodiments, lyophilized bacterial strains described herein are placed in an enterically coated soft gel or capsule.

In one aspect, a pharmaceutical composition comprises a lyophilized formulation further comprising a reducing agent. In certain embodiments, the reducing agent comprises cysteine selected from the group consisting of D-cysteine and L-cysteine. In another aspect, cysteine is at a concentration of at least about 0.025%. In one aspect, cysteine is at a concentration of about 0.025%. In another aspect, cysteine is at a concentration of 0.025%. In another aspect, another reducing agent other than cysteine is used in lieu of, or in combination with cysteine. In an aspect, another reducing agent is selected from the group comprising ascorbic acid, sodium ascorbate, thioglycolic acid, sodium sulfite, sodium bisulfite, sodium metabisulfite, potassium metabisulfite, Glutathione, Methionine, thioglycerol, and alpha tocopherol.

In one aspect, cysteine is at a concentration of at least about 0.005%, at least about 0.01%, at least about 0.015%, at least about 0.02%, at least about 0.025%, at least about 0.03%, at least about 0.035%, at least about 0.04%, at least about 0.045%, at least about 0.05%, at least about 0.055%, at least about 0.06%, at least about 0.065%, at least about 0.07%, at least about 0.075%, at least about 0.08%, at least about 0.085%, at least about 0.09%, at least about 0.095%, at least about 0.1%, at least about 0.12%, at least about 0.14%, at least about 0.16%, at least about 0.18%, at least about 0.2%, at least about 0.25%, at least about 0.3%, at least about 0.4%, at least about 0.5%, at least about 0.6%, at least about 0.7%, at least about 0.8%, at least about 0.9%, at least about 1%, at least about 2%, at least about 4%, at least about 6%, at least about 8%, at least about 10%, at least about 12%, at least about 14%, at least about 16%, at least about 18%, at least about 20%, at least about 22%, at least about 24%, or at least about 26%.

In one aspect, a therapeutic composition comprises a cryoprotectant. As used herein, a "cryoprotectant" refers to a substance that is added to a formulation in order to protect an active ingredient during freezing. In an aspect, a cryoprotectant comprises, consists essentially of, or consists of polyethylene glycol, skim milk, erythritol, arabitol, sorbitol, glucose, fructose, alanine, glycine, proline, sucrose, lactose, ribose, trehalose, dimethyl sulfoxide (DMSO), glycerol, or a combination thereof. In an aspect of the present disclosure, a cryoprotectant can be selected from the group comprising 5% Sucrose; 10% Sucrose; 10% Skim milk; 10% Trehalose with 2.5% sucrose; 5% Trehalose with 2.5% sucrose; 5% Mannitol; 5% Mannitol with 0.1% Polysorbate 80; 10% Mannitol; 10% Mannitol with 0.1% Polysorbate 80; 5% Trehalose; 5% Trehalose with 0.1% Polysorbate 80; 10% Trehalose; and 10% Trehaolse with 0.1% Polysorbate 80.

In another aspect, a therapeutic composition comprises a lyoprotectant. As used herein, a "lyoprotectant" refers to a substance that is added to a formulation in order to protect an active ingredient during the drying stage of a lyophilization (also known as freeze-drying) process. In one aspect, the same substance or the same substance combination is used as both a cryoprotectant and a lyoprotectant. Exemplary lyoprotectants include sugars such as sucrose or trehalose; an amino acid such as monosodium glutamate or histidine; a methylamine such as betaine; a lyotropic salt such as magnesium sulfate; a polyol such as trihydric or higher sugar alcohols, e.g. glycerin, erythritol, glycerol, arabitol, xylitol, sorbitol, and mannitol; propylene glycol; polyethylene glycol; Pluronics; and combinations thereof. In one aspect, a lyoprotectant is a non-reducing sugar, such as trehalose or sucrose. In one aspect, a cryoprotectant or a lyoprotectant consists essentially of, or consists of, one or more substances mentioned in this paragraph and the paragraph above.

In one aspect, a cryoprotectant or a lyoprotectant comprise an intracellular agent, e.g., DMSO, Glycerol, or PEG, which penetrates inside the cell preventing the formation of ice crystals that could result in membrane rupture. In another aspect, a cryoprotectant or a lyoprotectant comprise an extracellular agent, e.g., sucrose, trehalose, or dextrose, which does not penetrate into the cell membrane but acts to improve the osmotic imbalance that occurs during freezing.

In one aspect, the present disclosure provides a pharmaceutical composition comprising a lyophilized fecal microbe preparation comprising a lyophilization formulation comprising at least about 12.5% trehalose.

In one aspect, a lyophilization formulation comprises at least about 5%, at least about 7.5%, at least about 10%, at least about 12.5%, at least about 13%, at least about 13.5%, at least about 14%, at least about 14.5%, at least about 15%, at least about 15.5%, at least about 16%, at least about 16.5%, at least about 17%, at least about 17.5%, at least about 18%, at least about 18.5%, at least about 19%, at least about 19.5%, at least about 20%, at least about 22.5%, at least about 25%, at least about 27.5%, at least about 30%, at least about 32.5%, at least about 35%, at least about 37.5%, at least about 40%, at least about 42.5%, at least about 45%, at least about 47.5%, at least about 50%, at least about 52.5%, at least about 55%, at least about 57.5%, or at least about 60% of trehalose.

In various embodiments, the formulations of the present invention take the form of those as described in one or more of U.S. Pat. Nos. 8,535,713 and 8,911,777 and US Patent Publication Nos. 20120141585, 20120141531, 2006/001896, 2007/0292523, 2008/0020018, 2008/0113031, 2010/0203120, 2010/0255087, 2010/0297221, 2011/0052645, 2013/0243873, 2013/0330411, 2014/0017313, and 2014/0234418, the contents of which are hereby incorporated by reference in their entirety.

In various embodiments, the formulations of the present invention take the form of those as described in International Patent Publication No. WO 2008/135090, the contents of which are hereby incorporated by reference in their entirety.

In various embodiments, the formulations of the present invention take the form of those described in one or more of U.S. Pat. Nos. 4,196,564; 4,196,565; 4,247,006; 4,250,997; 4,268,265; 5,317,849; 6,572,892; 7,712,634; 8,074,835; 8,398,912; 8,440,224; 8,557,294; 8,646,591; 8,739,812; 8,810,259; 8,852,631; and 8,911,788 and US Patent Publication Nos. 2014/0302132; 2014/0227357; 20140088202; 20130287842; 2013/0295188; 2013/0307962; and 20130184290, the contents of which are hereby incorporated by reference in their entirety.

Administration and Dosage

It will be appreciated that the actual dose of the bacterial strains (and/or additional therapeutic agents) to be administered according to the present invention will vary according to, for example, the particular dosage form and the mode of administration. Many factors that may modify the action of the bacterial strains (e.g., body weight, gender, diet, time of administration, route of administration, rate of excretion, condition of the subject, drug combinations, genetic disposition and reaction sensitivities) can be taken into account by those skilled in the art. Administration can be carried out continuously or in one or more discrete doses within the maximum tolerated dose. Optimal administration rates for a given set of conditions can be ascertained by those skilled in the art using conventional dosage administration tests.

In various embodiments, the dose of the bacterial strains is effective to modulate a patient's microbiome to favor an ecological balance, i.e., treating or preventing a GI disorder described herein.

In various embodiments, the dose of the bacterial strains comprises at least $1\times10^4$, $1\times10^5$, $1\times10^6$, $1\times10^7$, $1\times10^8$, $1\times10^9$, $1\times10^{10}$, $1\times10^{11}$ or greater than $1\times10^{11}$ colony forming units (CFUs) or bacteria (e.g., germinable bacterial spores).

Individual doses of the bacterial strains (and/or additional therapeutic agents) can be administered in unit dosage forms (e.g., tablets or capsules) containing, for example, from about 0.01 mg to about 5,000 mg, from about 0.01 mg to about 4,000 mg, from about 0.01 mg to about 3,000 mg, from about 0.01 mg to about 2,000 mg, from about 0.01 mg to about 1,000 mg, from about 0.01 mg to about 950 mg, from about 0.01 mg to about 900 mg, from about 0.01 mg to about 850 mg, from about 0.01 mg to about 800 mg, from about 0.01 mg to about 750 mg, from about 0.01 mg to about 700 mg, from about 0.01 mg to about 650 mg, from about 0.01 mg to about 600 mg, from about 0.01 mg to about 550 mg, from about 0.01 mg to about 500 mg, from about 0.01 mg to about 450 mg, from about 0.01 mg to about 400 mg, from about 0.01 mg to about 350 mg, from about 0.01 mg to about 300 mg, from about 0.01 mg to about 250 mg, from about 0.01 mg to about 200 mg, from about 0.01 mg to about 150 mg, from about 0.01 mg to about 100 mg, from about 0.1 mg to about 90 mg, from about 0.1 mg to about 80 mg, from about 0.1 mg to about 70 mg, from about 0.1 mg to about 60 mg, from about 0.1 mg to about 50 mg, from about 0.1 mg to about 40 mg, from about 0.1 mg to about 30 mg, from about 0.1 mg to about 20 mg, from about 0.1 mg to about 10 mg, from about 0.1 mg to about 5 mg, from about 0.1 mg to about 3 mg, from about 0.1 mg to about 1 mg of the active ingredient per unit dosage form, or from about 5 mg to about 80 mg per unit dosage form. For example, a unit dosage form can include about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 150 mg, about 200 mg, about 250 mg, about 300 mg, about 350 mg, about 400 mg, about 450 mg, about 500 mg, about 550 mg, about 600 mg, about 650 mg, about 700 mg, about 750 mg, about 800 mg, about 850 mg, about 900 mg, about 950 mg, about 1,000 mg, about 2,000 mg, about 3,000 mg, about 4,000 mg, or about 5,000 mg of the active ingredient, inclusive of all values and ranges therebetween.

In one embodiment, the bacterial strains (and/or additional therapeutic agents) is administered at an amount of from about 0.01 mg to about 100 mg daily, an amount of from about 0.01 mg to about 5,000 mg daily, about 0.01 mg to about 4,000 mg daily, about 0.01 mg to about 3,000 mg daily, about 0.01 mg to about 2,000 mg daily, about 0.01 mg to about 1,000 mg daily, from about 0.01 mg to about 950 mg daily, from about 0.01 mg to about 900 mg daily, from about 0.01 mg to about 850 mg daily, from about 0.01 mg to about 800 mg daily, from about 0.01 mg to about 750 mg daily, from about 0.01 mg to about 700 mg daily, from about 0.01 mg to about 650 mg daily, from about 0.01 mg to about 600 mg daily, from about 0.01 mg to about 550 mg daily, from about 0.01 mg to about 500 mg daily, from about 0.01 mg to about 450 mg daily, from about 0.01 mg to about 400 mg daily, from about 0.01 mg to about 350 mg daily, from about 0.01 mg to about 300 mg daily, from about 0.01 mg to about 250 mg daily, from about 0.01 mg to about 200 mg daily, from about 0.01 mg to about 150 mg daily, from about 0.1 mg to about 100 mg daily, from about 0.1 mg to about 95 mg daily, from about 0.1 mg to about 90 mg daily, from about 0.1 mg to about 85 mg daily, from about 0.1 mg to about 80 mg daily, from about 0.1 mg to about 75 mg daily, from about 0.1 mg to about 70 mg daily, from about 0.1 mg to about 65 mg daily, from about 0.1 mg to about 60 mg daily, from about 0.1 mg to about 55 mg daily, from about 0.1 mg to about 50 mg daily, from about 0.1 mg to about 45 mg daily, from about 0.1 mg to about 40 mg daily, from about 0.1 mg to about 35 mg daily, from about 0.1 mg to about 30 mg daily, from about 0.1 mg to about 25 mg daily, from about 0.1 mg to about 20 mg daily, from about 0.1 mg to about 15 mg daily, from about 0.1 mg to about 10 mg daily, from about 0.1 mg to about 5 mg daily, from about 0.1 mg to about 3 mg daily, from about 0.1 mg to about 1 mg daily, or from about 5 mg to about 80 mg daily. In various embodiments, the bacterial strains (and/or additional therapeutic agents) is administered at a daily dose of about 0.01 mg, about 0.02 mg, about 0.03 mg, about 0.04 mg, about 0.05 mg, about 0.06 mg, about 0.07 mg, about 0.08 mg, about 0.09 mg, about 0.1 mg, about 0.2 mg, about 0.3 mg, about 0.4 mg, about 0.5 mg, about 0.6 mg, about 0.7 mg, about 0.8 mg, about 0.9 mg, about 1 mg, about 2 mg, about 3 mg, about 4 mg, about 5 mg, about 6 mg, about 7 mg, about 8 mg, about 9 mg about 10 mg, about 15 mg, about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, about 100 mg, about 150 mg, about 200 mg, about 250 mg, about 300 mg, about 350 mg, about 400 mg, about 450 mg, about 500 mg, about 550 mg, about 600 mg, about 650 mg, about 700 mg, about 750 mg, about 800 mg, about 850 mg, about 900 mg, about 950 mg, about 1,000 mg, about 2,000 mg, about 3,000 mg, about 4,000 mg, or about 5,000 mg inclusive of all values and ranges therebetween.

In some embodiments, a suitable dosage of the bacterial strains (and/or additional therapeutic agents) is in a range of about 0.01 mg/kg to about 100 mg/kg of body weight of the subject, for example, about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.1 mg/kg, about 1.2 mg/kg, about 1.3 mg/kg, about 1.4 mg/kg, about 1.5 mg/kg, about 1.6 mg/kg, about 1.7 mg/kg, about 1.8 mg/kg, 1.9 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg body weight, about 20 mg/kg body weight, about 30 mg/kg body weight, about 40 mg/kg body weight, about 50 mg/kg body weight, about 60 mg/kg body weight, about 70 mg/kg body weight, about 80 mg/kg body weight, about 90 mg/kg body weight, or about 100 mg/kg body weight, inclusive of all values and ranges therebetween. In other embodiments, a suitable dosage of the bacterial strains (and/or additional therapeutic agents) in a range of about 0.01 mg/kg to about 100 mg/kg of body weight, in a range of about 0.01 mg/kg to about 90 mg/kg of body weight, in a range of about 0.01 mg/kg to about 80 mg/kg of body weight, in a range of about 0.01 mg/kg to about 70 mg/kg of body weight, in a range of about 0.01 mg/kg to about 60 mg/kg of body weight, in a range of about 0.01 mg/kg to about 50 mg/kg of body weight, in a range of about 0.01 mg/kg to about 40 mg/kg of body weight, in a range of about 0.01 mg/kg to about 30 mg/kg of body weight, in a range of about 0.01 mg/kg to about 20 mg/kg of body weight, in a range of about 0.01 mg/kg to about 10 mg/kg of body weight, in a range of about 0.01 mg/kg to about 9 mg/kg of body weight, in a range of about 0.01 mg/kg to about 8 mg/kg of body weight, in a range of about 0.01 mg/kg to about 7 mg/kg of body weight, in a range of 0.01 mg/kg to about 6 mg/kg of body weight, in a range of about 0.05 mg/kg to about 5 mg/kg of body weight, in a range of about 0.05 mg/kg to about 4 mg/kg of body weight, in a range of about 0.05 mg/kg to about 3 mg/kg of body weight, in a range of about 0.05 mg/kg to about 2 mg/kg of body weight, in a range of about 0.05 mg/kg to about 1.5 mg/kg of body weight, or in a range of about 0.05 mg/kg to about 1 mg/kg of body weight.

In an aspect, a therapeutic composition provided here comprises a fecal microbiota comprising a Shannon Diversity Index of greater than or equal to 0.3, greater than or equal to 0.4, greater than or equal to 0.5, greater than or equal to 0.6, greater than or equal to 0.7, greater than or equal to 0.8, greater than or equal to 0.9, greater than or equal to 1.0, greater than or equal to 1.1, greater than or equal to 1.2, greater than or equal to 1.3, greater than or equal to 1.4, greater than or equal to 1.5, greater than or equal to 1.6, greater than or equal to 1.7, greater than or equal to 1.8, greater than or equal to 1.9, greater than or equal to 2.0, greater than or equal to 2.1, greater than or equal to 2.2, greater than or equal to 2.3, greater than or equal to 2.4, greater than or equal to 2.5, greater than or equal to 3.0, greater than or equal to 3.1, greater than or equal to 3.2, greater than or equal to 3.3, greater than or equal to 3.4, greater than or equal to 3.5, greater than or equal to 3.6, greater than or equal to 3.7, greater than or equal to 3.8, greater than or equal to 3.9, greater than or equal to 4.0, greater than or equal to 4.1, greater than or equal to 4.2, greater than or equal to 4.3, greater than or equal to 4.4, greater than or equal to 4.5, or greater than or equal to 5.0. In another aspect, a therapeutic composition comprises fecal microbiota comprising a Shannon Diversity Index of between 0.1 and 3.0, between 0.1 and 2.5, between 0.1 and 2.4, between 0.1 and 2.3, between 0.1 and 2.2, between 0.1 and 2.1, between 0.1 and 2.0, between 0.4 and 2.5, between 0.4 and 3.0, between 0.5 and 5.0, between 0.7 and 5.0, between 0.9 and 5.0, between 1.1 and 5.0, between 1.3 and 5.0, between 1.5 and 5.0, between 1.7 and 5.0, between 1.9 and 5.0, between 2.1 and 5.0, between 2.3 and 5.0, between 2.5 and 5.0, between 2.7 and 5.0, between 2.9 and 5.0, between 3.1 and 5.0, between 3.3 and 5.0, between 3.5 and 5.0, between 3.7 and 5.0, between 31.9 and 5.0, or between 4.1 and 5.0. In one aspect, a Shannon Diversity Index is calculated at the phylum level. In another aspect, a Shannon Diversity Index is calculated at the family level. In one aspect, a Shannon Diversity Index is calculated at the genus level. In another aspect, a Shannon Diversity Index is calculated at the species level. In a further aspect, a therapeutic composition comprises a preparation of flora in proportional content that resembles a normal healthy human fecal flora.

As used herein, "Shannon Diversity Index" refers to a diversity index that accounts for abundance and evenness of species present in a given community using the formula:

$$H = -\sum_{i=1}^{R} (p_i)(\ln(p_i))$$

where H is Shannon Diversity Index, R is the total number of species in the community, and pi is the proportion of R made up of the ith species. Higher values indicate diverse and equally distributed communities, and a value of 0 indicates only one species is present in a given community. For further reference, see Shannon and Weaver, (1949) The mathematical theory of communication. The University of Illinois Press, Urbana. 117 pp.

In accordance with certain embodiments of the invention, the bacterial strains may be administered, for example, more than once daily, about once per day, about every other day, about every third day, about once a week, about once every two weeks, about once every month, about once every two months, about once every three months, about once every six months, or about once every year.

In one aspect, the present disclosure provides a method for treating a disorder in a subject in need thereof, where the method comprises administering to the subject a pharmaceutically active dose of a therapeutic composition described herein. In one aspect, the present disclosure provides a method for treating a disorder in a subject in need thereof, where the method comprises administering daily to the subject a pharmaceutically active dose of a therapeutic composition described herein. In one aspect, a therapeutic composition is administered to a patient in need thereof at least once daily for at least two consecutive days. In one aspect, a therapeutic composition is administered at least once daily for at least 3, 4, 5, 6, 7, 8, 9, 10, 11, 12, 13, 14, or 15 consecutive days. In another aspect, a therapeutic composition is administered at least once daily for at least 1, 2, 3, 4, 5, 6, 7, 8, 9, 10, 11, or 12 consecutive weeks. In another aspect, a therapeutic composition is administered at least twice, three times, four times, or five times per week for at least 1, 2, 3, 4, 5, 6, 7, 8, 9, 10, 11, or 12 consecutive weeks. In one aspect, a therapeutic composition is administered at least once daily for at most 4, 5, 6, 7, 8, 9, 10, 11, 12, 13, 14, 15, 16, 17, 18, 19, or 20 consecutive days or weeks. In another aspect, a therapeutic composition is administered at least once daily for at most 1, 2, 3, 4, 5, 6, 7, 8, 9, 10, 11, or 12 consecutive weeks or months. In a further aspect, a therapeutic composition is administered at least once for at least 1, 2, 3, 4, 5, 6, 7, 8, 9, 10, 11, or 12 consecutive months or years, chronically for a subject's entire life span, or an indefinite period of time.

In one aspect, a therapeutic composition is administered to a patient in need thereof at least twice daily for at least two consecutive days. In one aspect, a therapeutic composition is administered at least twice daily for at least 3, 4, 5, 6, 7, 8, 9, 10, 11, 12, 13, 14, or 15 consecutive days. In another aspect, a therapeutic composition is administered at least twice daily for at least 1, 2, 3, 4, 5, 6, 7, 8, 9, 10, 11, or 12 consecutive weeks. In one aspect, a therapeutic composition is administered at least twice daily for at most 4, 5, 6, 7, 8, 9, 10, 11, 12, 13, 14, 15, 16, 17, 18, 19, or 20 consecutive days or week. In another aspect, a therapeutic composition is administered at least twice daily for at most 1, 2, 3, 4, 5, 6, 7, 8, 9, 10, 11, or 12 consecutive weeks or months. In a further aspect, a therapeutic composition is administered at least twice for at least 1, 2, 3, 4, 5, 6, 7, 8, 9, 10, 11, or 12 consecutive months or years, chronically for a subject's entire life span, or an indefinite period of time.

In one aspect, a therapeutic composition is administered to a patient in need thereof at least three times daily for at least two consecutive days. In one aspect, a therapeutic composition is administered at least three times daily for at least 3, 4, 5, 6, 7, 8, 9, 10, 11, 12, 13, 14, or 15 consecutive days. In another aspect, a therapeutic composition is administered at least three times daily for at least 1, 2, 3, 4, 5, 6, 7, 8, 9, 10, 11, or 12 consecutive weeks. In one aspect, a therapeutic composition is administered at least three times daily for at most 4, 5, 6, 7, 8, 9, 10, 11, 12, 13, 14, 15, 16, 17, 18, 19, or 20 consecutive days or weeks. In another aspect, a therapeutic composition is administered at least three times daily for at most 1, 2, 3, 4, 5, 6, 7, 8, 9, 10, 11, or 12 consecutive weeks or months. In a further aspect, a therapeutic composition is administered at least three times for at least 1, 2, 3, 4, 5, 6, 7, 8, 9, 10, 11, or 12 consecutive months or years, chronically for a subject's entire life span, or an indefinite period of time.

In one aspect, the present disclosure provides a method for treating a disorder in a subject in need thereof, where the method comprises administering orally to the subject a pharmaceutically active dose of a therapeutic composition comprising live, non-pathogenic, synthetic bacterial mixture or live, non-pathogenic, purified or extracted, fecal microbiota in a lyophilized formulation described herein, where the dose is administered at a dosing schedule of at least once or twice daily for at least three consecutive days or weeks. In another aspect, a dose is administered at least once, twice, or three times daily for a period between 1 and 12 weeks, between 2 and 12 weeks, between 3 and 12 weeks, between 4 and 12 weeks, between 5 and 12 weeks, between 6 and 12 weeks, between 7 and 12 weeks, between 8 and 12 weeks, between 9 and 12 weeks, between 10 and 12 weeks, between 1 and 2 weeks, between 2 and 3 weeks, between 3 and 4 weeks, between 4 and 5 weeks, between 5 and 6 weeks, between 6 and 7 weeks, between 7 and 8 weeks, between 8 and 9 weeks, between 9 and 10 weeks, or between 10 and 11 weeks.

In one aspect, the present disclosure provides a method for treating a disorder in a subject in need thereof by administering a pharmaceutical composition described herein, where the method comprises a first dosing schedule followed by a second dosing schedule. In one aspect, a first dosing schedule comprises a treatment or induction dose. In one aspect, a first dosing schedule comprises a continuous dosing schedule. In another aspect, a second dosing schedule comprises a maintenance dose lower than or equal to a pharmaceutically active dose of a first dosing schedule. In another aspect, a second dosing schedule lasts for at least about 2, 4, 6, 8, 10, 12, 18, 24, 36, 48, 72, or 96 months. In one aspect, a second dosing schedule lasts permanently, for a treated subject's entire life span, or an indefinite period of time. In one aspect, a second dosing schedule is a continuous dosing schedule. In another aspect, a second dosing schedule is an intermittent dosing schedule. In a further aspect, a second dosing schedule is an intermittent dosing schedule comprising a treatment period of at least 1, 2, 3, 4, 5, 6, 7, 8, 9, 10, 11, 12, 13, or 14 days followed by a resting period of at least 1, 2, 3, 4, 5, 6, 7, 8, 9, 10, 11, 12, 13, or 14 days. In another aspect, a second dosing schedule comprises administering a second dose (e.g., a maintenance dose) every other day, every two days, or every 3, 4, 5, 6, 7, 8 days. In another aspect, a maintenance dose is administered for an extended period of time with or without titration (or otherwise changing the dosage or dosing schedule). In one aspect, the interval between a first and a second dosing schedule is at least about 1, 2, 3, 4, 5, 6, 7, 8, 9, 10, 11, or 12 weeks. In another aspect, a second dosing schedule (e.g., a maintenance dose) comprises a dosage about 2, 5, 10, 50, 100, 200, 400, 800, 1000, 5000 or more fold lower than the dosage used in a first dosing schedule (e.g., an initial treatment dose). In another aspect, a second dosing schedule (e.g., a maintenance dosing schedule) has an equal or lower dosing frequency than a first dosing schedule (e.g., an initial treatment dosing schedule). In another aspect, a second dosing schedule (e.g., a maintenance dosing schedule) has a higher dosing interval than a first dosing schedule (e.g., an initial treatment dosing schedule).

In one aspect, a first or second dosing schedule used in a method can be once-a-week, twice-a-week, or thrice-a-week. The term "once-a-week" means that a dose is administered once in a week, preferably on the same day of each week. "Twice-a-week" means that a dose is administered two times in a week, preferably on the same two days of each weekly period. "Thrice-a-week" means that a dose is administered three times in a week, preferably on the same three days of each weekly period.

Additional Therapeutic Agents and Combination Therapy or Co-Formulation

Administration of the present formulations may be combined with additional therapeutic agents. Co-administration of the additional therapeutic agent and the present formulations may be simultaneous or sequential. Further; the present formulations may comprise an additional therapeutic agent (e.g., via co-formulation). For example, the additional therapeutic agent and the bacterial strains may be combined into a single formulation.

In one embodiment, the additional therapeutic agent and the bacterial strains are administered to a subject simultaneously. The term "simultaneously" as used herein, means that the additional therapeutic agent and the bacterial strains are administered with a time separation of no more than about 60 minutes, such as no more than about 30 minutes, no more than about 20 minutes, no more than about 10 minutes, no more than about 5 minutes, or no more than about 1 minute. Administration of the additional therapeutic agent and the bacterial strains can be by simultaneous administration of a single formulation (e.g., a formulation comprising the additional therapeutic agent and the bacterial strains) or of separate formulations (e.g., a first formulation including the additional therapeutic agent and a second formulation including the bacterial strains).

Co-administration does not require the additional therapeutic agents to be administered simultaneously, if the timing of their administration is such that the pharmacological activities of the additional therapeutic agent and the bacterial strains overlap in time. For example, the additional therapeutic agent and the bacterial strains can be administered sequentially. The term "sequentially" as used herein means that the additional therapeutic agent and the bacterial strains are administered with a time separation of more than about 60 minutes. For example, the time between the sequential administration of the additional therapeutic agent and the bacterial strains can be more than about 60 minutes, more than about 2 hours, more than about 5 hours, more than about 10 hours, more than about 1 day, more than about 2 days, more than about 3 days, or more than about 1 week apart. The optimal administration times will depend on the rates of metabolism, excretion, and/or the pharmacodynamic activity of the additional therapeutic agent and the bacterial strains being administered. Either the additional therapeutic agent or the bacterial strains may be administered first.

In a further embodiment, the additional therapeutic agent and the bacterial strains are administered to a subject simultaneously but the release of additional therapeutic agent and the bacterial strains from their respective dosage forms (or single unit dosage form if co-formulated) in the GI tract occurs sequentially.

Co-administration also does not require the additional therapeutic agents to be administered to the subject by the same route of administration. Rather, each additional therapeutic agent can be administered by any appropriate route, for example, parentally or non-parentally.

In some embodiments, the additional therapeutic agent is an agent used in the current standard-of-care induction therapies for the pathogenic bacteria that the subject is currently infected with and/or is at risk for being infected with, e.g., one or more anti-inflammatory agents, probiotic agents, prebiotic agents, antidiarrheal agents, analgesics, and antibiotic agents.

In some embodiments, the additional therapeutic agent is an anti-inflammatory agent such as steroidal anti-inflammatory agents or non-steroidal anti-inflammatory agents (NSAIDS). Steroids, particularly the adrenal corticosteroids and their synthetic analogues, are well known in the art. Examples of corticosteroids useful in the present invention include, without limitation, hydroxyltriamcinolone, alpha-methyl dexamethasone, beta-methyl betamethasone, beclomethasone dipropionate, betamethasone benzoate, betamethasone dipropionate, betamethasone valerate, clobetasol valerate, desonide, desoxymethasone, dexamethasone, diflorasone diacetate, diflucortolone valerate, fluadrenolone, fluclorolone acetonide, flumethasone pivalate, fluosinolone acetonide, fluocinonide, flucortine butylester, fluocortolone, fluprednidene (fluprednylidene) acetate, flurandrenolone, halcinonide, hydrocortisone acetate, hydrocortisone butyrate, methylprednisolone, triamcinolone acetonide, cortisone, cortodoxone, flucetonide, fludrocortisone, difluorosone diacetate, fluradrenolone acetonide, medrysone, amcinafel, amcinafide, betamethasone and the balance of its esters, chloroprednisone, clocortelone, clescinolone, dichlorisone, difluprednate, flucloronide, flunisolide, fluorometha-lone, fluperolone, fluprednisolone, hydrocortisone, meprednisone, paramethasone, prednisolone, prednisone, beclomethasone dipropionate. (NSAIDS) that may be used in the present invention, include but are not limited to, salicylic acid, acetyl salicylic acid, methyl salicylate, glycol salicylate, salicylmides, benzyl-2,5-diacetoxybenzoic acid, ibuprofen, fulindac, naproxen, ketoprofen, etofenamate, phenylbutazone, and indomethacin. Additional anti-inflammatory agents are described, for example, in U.S. Pat. No. 4,537,776, the entire contents of which are incorporated by reference herein.

In some embodiments, the additional therapeutic agent is a probiotic. Probiotics suitable for use in the present invention include, but are not limited to, *Saccharomyces boulardii; Lactobacillus rhamnosus* GG; *Lactobacillus plantarum* 299v; *Clostridium butyricum* M588; *Clostridium difficile* VP20621 (non-toxigenic *C. difficile* strain); combination of *Lactobacillus casei, Lactobacillus acidophilus* (Bio-K+ CL1285); combination of *Lactobacillus casei, Lactobacillus bulgaricus, Streptococcus thermophilus* (Actimel); combination of *Lactobacillus acidophilus, Bifidobacterium bifidum* (Florajen3); combination of *Lactobacillus acidophilus, Lactobacillus bulgaricus delbrueckii* subsp. *bulgaricus, Lactobacillus bulgaricus casei, Lactobacillus bulgaricus plantarum, Bifidobacterium longum, Bifidobacterium infantis, Bifidobacterium breve*, and *Streptococcus salivarius* subsp. *thermophilus* (VSL #3)).

The compositions and methods of the present invention may further comprise one or more prebiotics.

A prebiotic is a substrate that is selectively used by a host microorganism to produce a health benefit in a subject/patient. Without wishing to be bound by theory, prebiotics are added to nutritionally supplement bacteria in the microbiome and/or in a microbial composition, e.g., to stimulate the growth or activity of one or more strains of beneficial bacteria. Additionally, the prebiotics may be added to prevent "shock" to bacterial strains subsequent to their isolation or purification, freezing, freeze-drying, spray-drying, reconstitution in solution and the like.

Examples of prebiotics include amino acids, ammonium nitrate, amylose, barley mulch, biotin, carbonate, cellulose, chitin, choline, fructooligosaccharides (FOSs), fructose, galactooligosaccharides (GOSs), glucose, glycerol, heteropolysaccharide, histidine, homopolysaccharide, hydroxyapatite, inulin, isomaltulose, lactose, lactulose, maltodextrins, maltose, mannooligosaccharides, tagatose, nitrogen, oligodextrose, oligofructoses, oligofructose-enriched inulin, oligosaccharides, pectin, phosphate salts, phosphorus, polydextroses, polyols, potash, potassium, sodium nitrate, starch, sucrose, sulfur, sun fiber, tagatose, thiamine, trans-galactooligosaccharides, trehalose, vitamins, a water-soluble carbohydrate, and/or xylooligosaccharides (XOSs).

In embodiments, a prebiotic can be added (e.g., in dry or liquid forms) to a microbial composition of the present invention.

Alternately, or additionally, a prebiotic can be included (e.g., in dry or liquid forms) in a distinct pharmaceutical composition which lacks a microbial composition of the present invention.

A prebiotic may be provided to a subject before, contemporaneously with, and/or after a pharmaceutical composition comprising a microbial composition of the present invention is administered, either in a pharmaceutical composition comprising the microbial composition or in a pharmaceutical composition lacking a microbial composition.

A prebiotic may be provided in a single dose or in multiple doses. When provided as a single composition, the single composition may comprise a single prebiotic or a mixture of prebiotics. When provided in multiple compositions, each composition may comprise a single prebiotic or a mixture of prebiotics.

As examples, when multiple doses are provided, a first composition comprising a prebiotic may include one specific prebiotic, e.g., inulin, and a second composition may include a second specific prebiotic, e.g., pectin. Alternately, a first composition may include a mixture of prebiotics, e.g., inulin and pectin and a second composition may include different mixture of prebiotics, e.g., inulin and a FOS. A first composition may include a mixture of prebiotics and a second composition may include one specific prebiotic.

The amount of prebiotic provided to a subject/patient and/or included in a composition depends on the specific prebiotic, the specific bacterial strain of beneficial bacteria, and/or the disease state of the subject/patient In some embodiments, the additional therapeutic agent is an antidiarrheal agent. Antidiarrheal agents suitable for use in the present invention include, but are not limited to, DPP-IV inhibitors, natural opioids, such as tincture of opium, paregoric, and codeine, synthetic opioids, such as diphenoxylate, difenoxin and loperamide, bismuth subsalicylate, lanreotide, vapreotide and octreotide, motiln antagonists, COX2 inhibitors like celecoxib, glutamine, thalidomide and traditional antidiarrheal remedies, such as kaolin, pectin, berberine and muscarinic agents.

In some embodiments, the additional therapeutic agent may be an analgesic. Analgesics useful in the compositions and methods of the present invention include, without limitation, morphine, codeine, heroine, methadone and related compounds, thebaine, orpiavine, and their derivatives, buprenorphine, the piperidines, morphinans, benzomorphans, tetrahydroisoquinolines, thiambutanes, benzylamines, tilidine, viminol, nefopam, capsaicin(8-methyl-N-vanillyl-6E-nonenamide), "synthetic" capsaicin(N-vanillylnonamide), and related compounds.

In some embodiments, the additional therapeutic agent is an antibacterial agent, which includes, but is not limited to, cephalosporin antibiotics (cephalexin, cefuroxime, cefadroxil, cefazolin, cephalothin, cefaclor, cefamandole, cefoxitin, cefprozil, and ceftobiprole); fluoroquinolone antibiotics (cipro, Levaquin, floxin, tequin, avelox, and norflox); tetracycline antibiotics (tetracycline, minocycline, oxytetracycline, and doxycycline); penicillin antibiotics (amoxicillin, ampicillin, penicillin V, dicloxacillin, carbenicillin, vancomycin, and methicillin); monobactam antibiotics (aztreonam); and carbapenem antibiotics (ertapenem, doripenem, imipenem/cilastatin, and meropenem). In some embodiments, the anti-bacterial agent may be any of the penicillin, cephalosporin, monobactam, and carbapenem antibiotics.

In some embodiments, the additional therapeutic agent includes, but is not limited to, short-chain fatty acids, butyrate, propionate, acetate, IL-2, IL-22, superoxide dismutase (SOD), GLP-2 and analogs, GLP-1, IL-10, IL-27, TGF-β1, TGF-β2, N-acylphosphatidylethanolamines (NAPEs), elafin (also called peptidase inhibitor 3 and SKALP), trefoil factor, melatonin, tryptophan, PGD2, and kynurenic acid, indole metabolites, and other tryptophan metabolites.

Aspects of the present invention relate to pharmaceutical compositions comprising a bacterial mixture and an anti-cancer therapeutic agent. The anti-cancer therapeutic agent may be a chemotherapeutic agent. In a pharmaceutical composition of the present invention, a chemotherapeutic agent that can be formulated for oral administration and the bacterial mixture may be combined and encapsulated together in a capsule. Alternately, the chemotherapeutic agent may be included in a layer coating a capsule which encapsulates the bacterial mixture. In embodiments, the chemotherapeutic agent and the pharmaceutical composition comprising the bacterial mixture are in separate dosage forms. In embodiments, a subject in need thereof has received, is receiving, or will receive chemotherapeutic agent, either with or separate from a bacterial mixture.

In embodiments, any chemotherapeutic agent that can be formulated for oral administration may be used in con. Examples of such chemotherapeutic agents include Afinitor (everolimus), Alecensa (alectinib), Alkeran (melphalan), Alunbrig (brigatinib), Arimidex (anastrozole), Aromasin (exemestane), Bosulif (bosutinib), Cabometyx (cabozantinib), Caprelsa (vandetanib), Casodex (bicalutamide), Cometriq (cabozantinib), Cotellic (cobimetinib), Cyclophosphamide (cyclophosphamide caps), Cytoxan (Cyclophosphamide), Droxia (hydroxyurea), Emcyt (estramustine), Erivedge (vismodegib), etoposide, Fareston (toremifene citrate), Farydak (panobinostat), Femara (letrozole), flutamide, Gilotrif (afatinib), Gleevec (imatinib), Gleostine (lomustine), Hexalen (altretamine), Hycamtin (topotecan), Hydrea (hydroxyurea), Ibrance (palbociclib), Iclusig (ponatinib), Idamycin (Idarubicin), Idhifa (enasidenib), Imbruvica (ibrutinib), Inlyta (axitinib), Iressa (gefitinib), Jakafi (ruxolitinib), Kisqali (ribociclib), Kisqali Femara Co-Pack (ribociclib and letrozole), Lenvima (lenvatinib), leucovorin, Leukeran (chlorambucil), Lonsurf (trifluridine/tipiracil), Lynparza (olaparib), Lysodren (mitotane), Matulane (procarbazine), Megace (megestrol acetate), Mekinist (trametinib), mercaptopurine, Mesnex (mesna), methotrexate, Myleran (busulfan), Navelbine (Vinorelbine), Nerlynx (neratinib), Nexavar (sorafenib), Nilandron (nilutamide), Ninlaro (ixazomib), Odomzo (sonidegib), Pomalyst (pomalidomide), Purixan (mercaptopurine susp), Revlimid (lenalidomide), Rubraca (rucaparib), Rydapt (midostaurin), Soltamox (tamoxifen citrate), Sprycel (dasatinib), Stivarga (regorafenib), Sutent (sunitinib), Tabloid (thioguanine), Tafinlar (dabrafenib), Tagrisso (osimertinib), tamoxifen, Tarceva (erlotinib), Targretin (bexarotene), Tasigna (nilotinib), Temodar (temozolomide), Thalomid (thalidomide), Toposar (Etoposide), tretinoin, Trexall (methotrexate), Tykerb (lapatinib), Venclexta (venetoclax), Votrient (pazopanib), Xalkori (crizotinib), Xatmep (methotrexate soln), Xeloda (capecitabinea), Xtandi (enzalutamide), Zejula (niraparib), Zelboraf (vemurafenib), Zolinza (vorinostat), Zydelig (idelalisib), Zykadia (ceritinib), or Zytiga (abiraterone), and a combination thereof.

In embodiments, a pharmaceutical composition can be in the form of a capsule, tablet, or pill. In embodiments, the capsule, tablet, or pill can be coated or otherwise compounded to provide a dosage form affording the advantage of prolonged action. For example, the capsule, tablet, or pill can comprise an inner dosage (e.g., a bacterial mixture) and an outer dosage component (e.g., a chemotherapeutic agent and/or additional therapeutic agent), the latter being in the form of an envelope over the former. The two components can be separated by an enteric layer which serves to resist disintegration in the stomach and permits the inner component to pass into the duodenum or colon and/or to be delayed in release. A variety of materials can be used for such enteric layers or coatings (as described herein). Exemplary materials include a number of polymeric acids and mixtures of polymeric acids with such materials as shellac, cetyl alcohol, and cellulose acetate.

For all additional therapeutic agent compositions and methods, targeting to various parts of the GI tract may be employed as described herein.

In various embodiments, the patient of the present methods is undergoing treatment with one or more additional therapeutic agents and, by way of non-limitation, such additional therapeutic agents may disrupt the microbiome.

Methods of Treatment

In various embodiments, the present invention provides methods of modulating a patient's microbiome to provide or restore an ecological balance. For instance, in various embodiments, there is provided methods or diminishing or inhibiting one or more pathogenic bacteria as described elsewhere herein. In various embodiments, the present mixture of bacterial strains augments growth of at least one type of bacteria not detectably present in a patient's GI tract prior to administration and, in various embodiments, which non-pathogenic.

In various embodiments, the present invention provides methods of restoring or enhancing ecological control over gut pathogens or pathobionts in a patient.

In various embodiments, the present invention provides methods of treating or preventing a disease or condition associated with GI dysbiosis, comprising administering an effective amount of a pharmaceutical composition described herein to a subject or a patient need thereof.

Without wishing to be bound by theory, the mixture of bacterial strains of the present invention acts to protect, maintain, and restore the gut barrier through one or more mechanisms. A first mechanism is production of Short-Chain Fatty Acid (SCFAs) which increase the thickness of the mucus layer, maintain the health of colonocytes, and induce IgA production. A second mechanism is through activation of Toll-Like Receptors (TLRs), which modulate the production of antimicrobial peptides, which target many human bacterial pathogens. In the second mechanism, various bacterial products stimulate the immune system through the TLR-MyD88 mediated pathway. Stimulation of this pathway results in the upregulation of antimicrobial proteins. Antimicrobial proteins and peptides are produced by the intestinal epithelial cells and Paneth cells to defend against undesired bacterial species (both commensal and pathogenic. Different bacterial products including often play a role in stimulation of this pathway. For example, flagellin is a TLR5 agonist that induces the production of the C-type lectin, RegIIIgamma. RegIIIgamma has roles in killing Gram-positive pathogens, including vancomycin resistant *Enterococcus* (VRE). Additionally, the mixture of bacterial strains of the present invention acts to protect, maintain, and restore the gut barrier through inducing a thickening of the colonic epithelial mucus, an increase in IgA production, an increase in antimicrobial peptide production and/or improved tight junction integrity.

In various embodiments, the methods of the invention comprise treating or preventing a microbiome-mediated disorder. Illustrative microbiome-mediated disorder includes, but are not limited to, for example, those found in Table 3 of WO 2014/121298, the entire contents of which are incorporated herein by reference.

In various embodiments, the present invention provides methods of treating a patient suffering from a disease or condition associated with GI dysbiosis. In some embodiments, the patient has inflammatory bowel diseases (IBD), for example, Crohn's disease, colitis (e.g., UC or microscopic colitis), or pouchitis. IBD is a group of inflammatory conditions of the large intestine and, in some cases, the small intestine. The main forms of IBD that may be treated by the prevent invention include, but are not limited to, Crohn's disease, UC, pouchitis, collagenous colitis, lymphocytic colitis, ischemic colitis, diversion colitis, Behçet's syndrome, infective colitis, and indeterminate colitis. In an embodiment, the present invention provides methods of treating UC. In another embodiment, the present invention provides methods of treating CD. In a further embodiment, the present invention provides methods of treating pouchitis.

In various embodiments, methods of the invention are utilized for the treatment of UC. UC is one form of IBD. It is a chronic disease of the colon, in which the lining of the colon becomes inflamed and develops tiny open sores, or ulcers, that produce pus and mucous. In some embodiments, methods of the invention ameliorate, reduce, or eliminate the inflammation and/or ulceration associated with UC. In some embodiments, methods of the invention ameliorate, reduce, or eliminate one or more symptoms associated with UC including but not limited to, abdominal discomfort or pain, frequent emptying of the colon, lose and urgent bowel movements, persistent diarrhea, bloody stool, loss of appetite, and weight loss. In some embodiments, methods of the invention may reduce or prevent the delay in growth and development in children afflicted with UC.

In some embodiments, the present invention provides methods of treating IBS. IBS is a common disorder that affects the colon and can cause cramping, abdominal pain, bloating, gas, diarrhea and constipation. IBS is classified based on the predominant symptom of diarrhea (IBS with predominant diarrhea, IBS-D), constipation (IBS with predominant constipation, IBS-C) or mixed symptoms (IBS with alternating constipation and diarrhea, IBS-A). Methods of the invention are effective in treating one or more of IBS-D, IBS-C, and/or IBS-A. In some embodiments, methods of the invention ameliorate, reduce, or eliminate one or more symptoms associated with one or more of IBS-D, IBS-C, and/or IBS-A.

In some embodiments, the present invention provides for compositions and methods for treating or preventing infections (including colonization) by pathogenic bacteria and/or inhibiting the growth or decrease the number of pathogenic bacteria in the GI tract. In an embodiment, the pathogenic bacteria are enterobacteria such as *Salmonella*. In various embodiments, the present invention provides for compositions and methods that mitigate or prevent the overgrowth of various coliforms in a patient's gut (including coliforms that are virulent and/or antibiotic resistant). Illustrative coliforms include *Citrobacter, Enterobacer, Hafnia, Kelbsiella*, and *Escherichia*. In some embodiments, the methods and compositions described herein prevent or diminish secondary infections with resistant organisms.

In still other embodiments, the present invention provides methods of treating a patient with an infectious disease of the intestines, for example, CDI and/or a CDAD, nosocomial infection, secondary emergent infection, amebiasis, intestinal tuberculosis, or parasitic disorder. In some embodiments, the present invention provides methods for treating or preventing a CDI and/or a CDAD, comprising administering an effective amount of a composition described herein to a subject or a patient need thereof. In various embodiments, the CDI or CDAD comprises one or more of: *C. difficile* diarrhea (CDD), *C. difficile* intestinal inflammatory disease, colitis, pseudomembranous colitis, fever, abdominal pain, dehydration and disturbances in electrolytes, megacolon, peritonitis, and perforation and/or rupture of the colon.

In various embodiments, the disease or condition associated with GI dysbiosis is treated or prevented in the context of initial onset or relapse/recurrence (e.g., due to continued or restarted antibiotic therapy). For example, in a patient that has previously suffered from a GI dysbiosis, the present composition or formulation may be administered upon the first symptoms of recurrence in the patient. By way of non-limiting example, symptoms of recurrence include, in a mild case, about 5 to about 10 watery bowel movements per day, no significant fever, and only mild abdominal cramps while blood tests may show a mild rise in the white blood cell count up to about 15,000 (normal levels are up to about 10,000), and, in a severe case, more than about 12 watery stools per day, nausea, vomiting, high fever (e.g., about 102-104° F.), rectal bleeding, severe abdominal pain (e.g., with tenderness), abdominal distention, and a high white blood count (e.g., of about 15,000 to about 40,000).

In some embodiments, the methods of the present invention are used to treat a subject or patient who is suffering from, or is susceptible to, a disease or condition associated with GI dysbiosis. For example, the patient may be undergoing or has undergone an initial and/or adjunctive therapy that renders the patient susceptible to a disease or condition associated with GI dysbiosis. In some embodiments, the patient is undergoing treatment, or has undergone treatment, with an antibiotic. For example, the patient may have taken an antibiotic during the past about 30 or so days and/or have an immune system that is weak (e.g., from a chronic illness). In another example, the patient may have recently been in the hospital, including in an intensive care unit. Accordingly, in some embodiments, the methods and uses of the present invention treat or prevent a nosocomial infection and/or a secondary emergent infection and/or a hospital acquired infection (HAI).

In various embodiments, the present invention provides methods for treating antibiotic-induced adverse effects in the GI tract, comprising administering an effective amount of a mixture of bacterial strains described herein (and/or additional therapeutic agents) to a subject in need thereof. In another embodiment, the present invention provides methods for preventing an antibiotic-induced adverse effect in the GI tract, comprising administering an effective amount of a mixture of bacterial strains described herein (and/or additional therapeutic agents) to a subject in need thereof.

In various embodiments, the mixtures of bacterial strains as described herein protect the intestinal microbiome from antibiotics-induced damage. In some embodiments, the methods of the invention treat or prevent an antibiotics-associated adverse effect including but not limited to diarrhea, nausea, vomiting, dysgeusia, colitis, and pseudomembranous colitis disease and/or symptoms. In an embodiment, methods of the invention can be used to treat or prevent antibiotic-associated diarrhea (AAD).

Methods for measuring change and/or improvement in GI tract function can include, but are not limited to: endoscopy for direct examination of epithelium and mucosa; histological evaluation and/or tissue procurement for direct evaluation of structural changes and/or immune biomarkers; urine tests for assessment of permeability with non-absorbable sugars and LPS levels; stool tests for assessment of inflammation and/or microbiota changes (for example by PCR); and/or blood tests for assessment of specific markers, including CD4+ cell counts, Th17 cell counts, and/or LPS levels.

In some embodiments, the methods of the present invention treat or prevent a diarrheal disease including, but not limited to, acute bloody diarrhea (e.g., dysentery), acute watery diarrhea (e.g., cholera), checkpoint inhibitor-associated colitis, diarrhea due to food poisoning, persistent diarrhea, and traveler's diarrhea.

In various embodiments, the methods of the present invention treat or prevent an IBD or related disease including, but not limited to, Crohn's disease, ulcerative colitis, collagenous colitis, lymphocytic colitis, diversion colitis, Behcet's disease, intermediate colitis, short bowel syndrome, ulcerative proctitis, proctosigmoiditis, left-sided colitis, pancolitis, and fulminant colitis.

In various embodiments, the methods of the present invention treat or prevent an autoimmune disorder including, but not limited to, acute disseminated encephalomyelitis (ADEM), acute necrotizing hemorrhagic leukoencephalitis, Addison's disease, agammaglobulinemia, alopecia areata, amyloidosis, ankylosing spondylitis, anti-GBM/anti-TBM nephritis, antiphospholipid syndrome (APS), autoimmune angioedema, autoimmune aplastic anemia, autoimmune dysautonomia, autoimmune hemolytic anemia, autoimmune hepatitis, autoimmune hyperlipidemia, autoimmune immunodeficiency, autoimmune inner ear disease (AIED), autoimmune myocarditis, autoimmune oophoritis, autoimmune pancreatitis, autoimmune retinopathy, autoimmune thrombocytopenic purpura (ATP), autoimmune thyroid disease, autoimmune urticarial, axonal & neuronal neuropathies, Balo disease, Behcet's disease, bullous pemphigoid, cardiomyopathy, Castleman disease, celiac disease, Chagas disease, chronic inflammatory demyelinating polyneuropathy (CIDP), chronic recurrent multifocal ostomyelitis (CRMO), Churg-Strauss syndrome, cicatricial pemphigoid/benign mucosal pemphigoid, Crohn's disease, Cogan's syndrome, cold agglutinin disease, congenital heart block, Coxsackie myocarditis, CREST disease, essential mixed cryoglobulinemia, demyelinating neuropathies, dermatitis herpetiformis, dermatomyositis, Devic's disease (neuromyelitis optica), discoid lupus, Dressler's syndrome, endometriosis, eosinophilic esophagitis, eosinophilic fasciitis, erythema nodosum, experimental allergic encephalomyelitis, Evans syndrome, fibrosing alveolitis, giant cell arteritis (temporal arteritis), giant cell myocarditis, glomerulonephritis, Goodpasture's syndrome, granulomatosis with polyangiitis (GPA), Graves' disease, Guillain-Barre syndrome, Hashimoto's encephalitis, Hashimoto's thyroiditis, hemolytic anemia, Henoch-Schonlein purpura, herpes gestationis, hypogammaglobulinemia, idiopathic thrombocytopenic purpura (ITP), IgA nephropathy, IgG4-related sclerosing disease, immunoregulatory lipoproteins, inclusion body myositis, interstitial cystitis, juvenile arthritis, juvenile idiopathic arthritis, juvenile myositis, Kawasaki syndrome, Lambert-Eaton syndrome, leukocytoclastic vasculitis, lichen planus, lichen sclerosus, ligneous conjunctivitis, linear IgA disease (LAD), lupus (systemic lupus erythematosus), chronic Lyme disease, Meniere's disease, microscopic polyangiitis, mixed connective tissue disease (MCTD), Mooren's ulcer, Mucha-Habermann disease, multiple sclerosis, myasthenia gravis, myositis, narcolepsy, neuromyelitis optica (Devic's), neutropenia, ocular cicatricial pemphigoid, optic neuritis, palindromic rheumatism, PANDAS (Pediatric Autoimmune Neuropsychiatric Disorders Associated with *Streptococcus*), paraneoplastic cerebellar degeneration, paroxysmal nocturnal hemoglobinuria (PNH), Parry Romberg syndrome, Parsonnage-Turner syndrome, pars planitis (peripheral uveitis), pemphigus, peripheral neuropathy, perivenous encephalomyelitis, pernicious anemia, POEMS syndrome, polyarteritis nodosa, type I, II, & III autoimmune polyglandular syndromes, polymyalgia rheumatic, polymyositis, postmyocardial infarction syndrome, postpericardiotomy syndrome, progesterone dermatitis, primary biliary cirrhosis, primary sclerosing cholangitis, psoriasis, psoriatic arthritis, idiopathic pulmonary fibrosis, pyoderma gangrenosum, pure red cell aplasia, Raynaud's phenomenon, reactive arthritis, reflex sympathetic dystrophy, Reiter's syndrome, relapsing polychondritis, restless legs syndrome, retroperitoneal fibrosis, rheumatic fever, rheumatoid arthritis, sarcoidosis, Schmidt syndrome, scleritis, scleroderma, Sjogren's syndrome, sperm & testicular autoimmunity, stiff person syndrome, subacute bacterial endocarditis (SBE), Susac's syndrome, sympathetic ophthalmia, Takayasu's arteritis, temporal arteritis/giant cell arteritis, thrombocytopenic purpura (TTP), Tolosa-Hunt syndrome, transverse myelitis, type 1 diabetes, asthma, ulcerative colitis, undifferentiated connective tissue disease (UCTD), uveitis, vasculitis, vesiculobullous dermatosis, vitiligo, and Wegener's granulomatosis.

In various embodiments, the methods of the present invention treat or prevent or reduce a side effect associated with an anti-cancer treatment. It is well known in the art that many anti-cancer treatments can affect the gut biosis. For example, chemotherapy can weaken the gut mucosa or change the mucosal-associated microbiota, including reduced diversity in the gut microbiome. Thus; such gut dysbiosis can lead to blood-stream infections. Additionally, the anti-cancer therapy can promote infection of and colonization of antibiotic resistant bacteria. See, e.g., Papanicolas et al., "Not Just Antibiotics: Is Cancer Chemotherapy Driving Antimicrobial Resistance?" *Trends Microbiol.* 2018 May; 26(5):393-400. Accordingly, bacterial mixtures of the present invention are useful in cancer-related applications, at least in decreasing the severity of a side effect and up to eliminating the side effect, e.g., in part, by protecting, maintaining, and restoring the integrity of the gut barrier before, during, and/or after receiving the anti-cancer therapy.

In aspects and embodiments, and without wishing to be bound by theory, the bacterial mixtures of the present invention may exert beneficial effects in oncology by maintaining responsiveness of a tumor, allowing an increased treatment dose (of the anti-cancer therapy) than otherwise possible, permitting administration of more frequent treatment doses (e.g., patient would not have to miss a session due to side effects), and/or boosting the immune system (e.g., for checkpoint inhibitor therapy).

In various embodiments, a subject in need thereof has received, is receiving, or will receive an anti-cancer therapeutic agent and/or an anti-cancer therapy.

Aspects of the present invention relate to methods for preventing or treating a cancer comprising administering a pharmaceutical composition comprising a microbial composition (with or without a chemotherapeutic agent that can be formulated for oral administration, as described herein) and administering an anti-cancer therapy.

In embodiments, a pharmaceutical composition is administered simultaneously (as described herein) with the anti-cancer therapy.

Alternately, the pharmaceutical composition and the anti-cancer therapy are administered sequentially. The term "sequentially" as used herein means that the anti-cancer therapy and the pharmaceutical composition are administered with a time separation of more than about 60 minutes. For example, the time between the sequential administration of the anti-cancer therapy and the pharmaceutical composition can be more than about 60 minutes, more than about 2 hours, more than about 5 hours, more than about 10 hours, more than about 1 day, more than about 2 days, more than about 3 days, more than about 1 week apart, more than 1 month apart, or longer. The optimal administration time will depend on the specific anti-cancer therapy and the pharmaceutical composition being administered. Either the anti-cancer therapy or the pharmaceutical composition may be administered first. In embodiments, the subject is administered pharmaceutical composition prior to the anti-cancer therapy, thereby helping ensure that the subject has a healthy gut biome prior to receiving the anti-cancer therapy. Alternately, the subject is administered pharmaceutical composition after the anti-cancer therapy, thereby helping the subject repair/repopulate his/her gut biome after receiving the anti-cancer therapy.

In embodiments, a bacterial mixture is administered enterally, e.g., orally, and the anti-cancer therapy is a chemotherapy or a targeted therapy which is administered parentally.

In aspects and embodiments, the anti-cancer therapy is a radiation therapy.

In aspects and embodiments, the anti-cancer therapy is a surgery, i.e., to excise a tumor or an organ/tissue comprising cancerous cells.

In aspects and embodiments, the anti-cancer therapy comprises a chemotherapy. Examples of chemotherapeutic agents include 5-FU (Fluorouracil), Abemaciclib, Abiraterone Acetate, Abitrexate (Methotrexate), Abraxane (Paclitaxel Albumin-stabilized Nanoparticle Formulation), ABVD, ABVE, ABVE-PC, AC, Acalabrutinib, AC-T, ADE, Adriamycin (Doxorubicin), Afatinib Dimaleate, Afinitor (Everolimus), Afinitor Difsperz (Everolimus), Akynzeo (Netupitant and Palonosetron), Aldara (Imiquimod), Aldesleukin, Alecensa (Alectinib), Alectinib, Alimta (PEMETREXED), Aliqopa (Copanlisib Hydrochloride), Alkeran (Melphalan), Aloxi (Palonosetron Hydrochloride), Alunbrig (Brigatinib), Ambochlorin (Chlorambucil), Amboclorin (Chlorambucil), Amifostine, Aminolevulinic Acid, Anastrozole, Aprepitant, Aredia (Pamidronate), Arimidex (Anastrozole), Aromasin (Exemestane), Arranon (Nelarabine), Arsenic Trioxide, Asparaginase *Erwinia chrysanthemi*, Axicabtagene Ciloleucel, Axitinib, Azacitidine, BEACOPP, Becenum (Carmustine), Beleodaq (Belinostat), Belinostat, Bendamustine Hydrochloride, BEP, Bexarotene, Bicalutamide, BiCNU (Carmustine), Blenoxane (Bleomycin), Bortezomib, Bosulif (Bosutinib), Bosutinib, Brigatinib, BuMel, Busulfan, Busulfex (Busulfan)C, Cabazitaxel, Cabometyx (Cabozantinib), Cabozantinib-S-Malate, CAF, Calquence (Acalabrutinib), Camptosar (Irinotecan Hydrochloride), Capecitabine, CAPOX, Caprelsa (Vandetanib), Carac (Fluorouracil—Topical), Carboplatin, CARBOPLATIN-TAXOL, Carfilzomib, Carmubris (Carmustine), Carmustine, Casodex (Bicalutamide), CeeNU (Lomustine), CEM, Ceritinib, Cerubidine (Daunorubicin), Cervarix (Recombinant HPV Bivalent Vaccine), CEV, Chlorambucil, CHLORAMBUCIL-PREDNISONE, CHOP, Cisplatin, Cladribine, Clafen (Cyclophosphamide), Clofarabine, Clofarex (Clofarabine), Clolar (Clofarabine), CMF, Cobimetinib, Cometriq (Cabozantinib), Copanlisib Hydrochloride, COPDAC, COPP, COPP-ABV, Cosmegen (Dactinomycin), Cotellic (Cobimetinib), Crizotinib, CVP, Cyclophosphamide, Cyfos (Ifosfamide), Cytarabine, Cytarabine Liposome, Cytosar-U (Cytarabine), Cytoxan (Cyclophosphamide), Cytoxan (Cytoxan), Dabrafenib, Dacarbazine, Dacogen (Decitabine), Dactinomycin, Dasatinib, Daunorubicin Hydrochloride, Daunorubicin Hydrochloride and Cytarabine Liposome, DaunoXome (Daunorubicin Lipid Complex), Decadron (Dexamethasone), Decitabine, Defibrotide Sodium, Defitelio (Defibrotide Sodium), Degarelix, Denileukin Diftitox, DepoCyt (Cytarabine Liposome), Dexamethasone, Dexamethasone Intensol (Dexamethasone), Dexpak Taperpak (Dexamethasone), Dexrazoxane Hydrochloride, Docefrez (Docetaxel), Docetaxel, Doxil (Doxorubicin Hydrochloride Liposome), Doxorubicin Hydrochloride, Doxorubicin Hydrochloride Liposome, Dox-SL (Doxorubicin Hydrochloride Liposome), Droxia (Hydroxyurea), DTIC (Decarbazine), DTIC-Dome (Dacarbazine), Efudex (Fluorouracil—Topical), Eligard (Leuprolide), Elitek (Rasburicase), Ellence (Ellence (epirubicin)), Eloxatin (Oxaliplatin), Elspar (Asparaginase), Eltrombopag Olamine, Emcyt (Estramustine), Emend (Aprepitant), Enasidenib Mesylate, Enzalutamide, Epirubicin Hydrochloride, EPOCH, Eribulin Mesylate, Erivedge (Vismodegib), Erlotinib Hydrochloride, Erwinaze (Asparaginase *Erwinia chrysanthemi*), Ethyol (Amifostine), Etopophos (Etoposide Phosphate), Etoposide, Etoposide Phosphate, Eulexin (Flutamide), Evacet (Doxorubicin Hydrochloride Liposome), Everolimus, Evista (Raloxifene Hydrochloride), Evomela (Melphalan Hydrochloride), Exemestane, Fareston (Toremifene), Farydak (Panobinostat), Faslodex (Fulvestrant), FEC, Femara (Letrozole), Filgrastim, Firmagon (Degarelix), FloPred (Prednisolone), Fludara (Fludarabine), Fludarabine Phosphate, Fluoroplex (Fluorouracil), Fluorouracil, Flutamide, Folex (Methotrexate), Folex PFS (Methotrexate), FOLFIRI, FOLFIRINOX, FOLFOX, Folotyn (Pralatrexate), FUDR (FUDR (floxuridine)), FU-LV, Fulvestrant, Gardasil (Recombinant HPV Quadrivalent Vaccine), Gardasil 9 (Recombinant HPV NonavalentVaccine), Gefitinib, Gemcitabine Hydrochloride, GEMCITABINE-CISPLATIN, GEMCITABINE-OXALIPLATIN, Gemzar (Gemcitabine), Gilotrif (Afatinib Dimaleate), Gilotrif (Afatinib), Gleevec (Imatinib Mesylate), Gliadel (Carmustine), Glucarpidase, Goserelin Acetate, Halaven (Eribulin Mesylate), Hemangeol (Propranolol Hydrochloride), Hexalen (Altretamine), HPV Bivalent Vaccine, Recombinant, HPV Nonavalent Vaccine, Recombinant, HPV Quadrivalent Vaccine, Recombinant, Hycamtin (Topotecan Hydrochloride), Hycamtin (Topotecan), Hydrea (Hydroxyurea), Hydroxyurea, Hyper-CVAD, Ibrance (Palbociclib), Ibrutinib, ICE, Iclusig (Ponatinib), Idamycin PFS (Idarubicin), Idarubicin Hydrochloride, Idelalisib, Idhifa (Enasidenib), Ifex (Ifosfamide), Ifosfamide, Ifosfamidum (Ifosfamide), Imatinib Mesylate, Imbruvica (brutinib), Imiquimod, Imlygic (Talimogene Laherparepvec), Inlyta (Axitinib), Iressa (Gefitinib), Irinotecan Hydrochloride, Irinotecan Hydrochloride Liposome, Istodax (Romidepsin), Ixabepilone, Ixazomib Citrate, Ixempra (Ixabepilone), Jakafi (Ruxolitinib Phosphate), Jakafi (Ruxolitinib), JEB, Jevtana (Cabazitaxel), Keoxifene (Raloxifene Hydrochloride), Kepivance (Palifermin), Kisqali (Ribociclib), Kyprolis (Carfilzomib), Lanreotide Acetate, Lanvima (Lenvatinib), Lapatinib Ditosylate, Lenalidomide, Lenvatinib Mesylate, Lenvima (Lenvatinib Mesylate), Letrozole, Leucovorin Calcium, Leukeran (Chlorambucil), Leukine (Sargramostim), Leuprolide Acetate, Leustatin (Cladribine), Levulan (Aminolevulinic Acid), Linfolizin (Chlorambucil), LipoDox (Doxorubicin Hydrochloride Liposome), Lomustine, Lonsurf (Trifluridine and Tipiracil), Lupron (Leuprolide), Lynparza (Olaparib), Lysodren (Mitotane), Marqibo (Vincristine Sulfate Liposome), Marqibo Kit (Vincristine Lipid Complex), Matulane (Procarbazine), Mechlorethamine Hydrochloride, Megace (Megestrol), Megestrol Acetate, Mekinist (Trametinib), Melphalan, Melphalan Hydrochloride, Mercaptopurine, Mesnex (Mesna), Metastron (Strontium-89 Chloride), Methazolastone (Temozolomide), Methotrexate, Methotrexate LPF (Methotrexate), Methylnaltrexone Bromide, Mexate (Methotrexate), Mexate-AQ (Methotrexate), Midostaurin, Mitomycin C, Mitoxantrone Hydrochloride, Mitozytrex (Mitomycin C), MOPP, Mostarina (Prednimustine), Mozobil (Plerixafor), Mustargen (Mechlorethamine), Mutamycin (Mitomycin), Myleran (Busulfan), Mylosar (Azacitidine), Nanoparticle Paclitaxel (Paclitaxel Albumin-stabilized Nanoparticle Formulation), Navelbine (Vinorelbine), Nelarabine, Neosar (Cyclophosphamide), Neratinib Maleate, Nerlynx (Neratinib), Netupitant and Palonosetron Hydrochloride, Neulasta (filgrastim), Neulasta (pegfilgrastim), Neupogen (filgrastim), Nexavar (Sorafenib), Nilandron (Nilutamide), Nilotinib, Nilutamide, Ninlaro (Ixazomib), Nipent (Pentostatin), Niraparib Tosylate Monohydrate, Nolvadex (Tamoxifen), Novantrone (Mitoxantrone), Nplate (Romiplostim), Odomzo (Sonidegib), OEPA, OFF, Olaparib, Omacetaxine Mepesuccinate, Oncaspar (Pegaspargase), Oncovin (Vincristine), Ondansetron Hydrochloride, Onivyde (Irinotecan Hydrochloride Liposome), Ontak (Denileukin Diftitox), Onxol (Paclitaxel), OPPA, Orapred (Prednisolone), Osimertinib, Oxaliplatin, Paclitaxel, Paclitaxel Albumin-stabilized Nanoparticle Formulation, PAD, Palbociclib, Palifermin, Palonosetron Hydrochloride, Palonosetron Hydrochloride and Netupitant, Pamidronate Disodium, Panobinostat, Panretin (Alitretinoin), Paraplat (Carboplatin), Pazopanib Hydrochloride, PCV, PEB, Pediapred (Prednisolone), Pegaspargase, Pegfilgrastim, Pemetrexed Disodium, Platinol (Cisplatin), PlatinolAQ (Cisplatin), Plerixafor, Pomalyst (Pomalidomide), Ponatinib Hydrochloride, Pralatrexate, Prednisone, Procarbazine Hydrochloride, Proleukin (Aldesleukin), Promacta (Eltrombopag Olamine), Propranolol Hydrochloride, Purinethol (Mercaptopurine), Purixan (Mercaptopurine), Radium 223 Dichloride, Raloxifene Hydrochloride, Rasburicase, R-CHOP, R-CVP, Reclast (Zoledronic acid), Recombinant Human Papillomavirus (HPV) Bivalent Vaccine, Recombinant Human Papillomavirus (HPV) Nonavalent Vaccine, Recombinant Human Papillomavirus (HPV) Quadrivalent Vaccine, Regorafenib, Relistor (Methylnaltrexone Bromide), R-EPOCH, Revlimid (Lenalidomide), Rheumatrex (Methotrexate), Ribociclib, R-ICE, Rolapitant Hydrochloride, Romidepsin, Romiplostim, Rubex (Doxorubicin), Rubidomycin (Daunorubicin Hydrochloride), Rubraca (Rucaparib), Rucaparib Camsylate, Ruxolitinib Phosphate, Rydapt (Midostaurin), Sandostatin (Octreotide), Sandostatin LAR Depot (Octreotide), Sclerosol Intrapleural Aerosol (Talc), Soltamox (Tamoxifen), Somatuline Depot (Lanreotide Acetate), Sonidegib, Sorafenib Tosylate, Sprycel (Dasatinib), STANFORD V, Sterapred (Prednisone), Sterapred DS (Prednisone), Sterile Talc Powder (Talc), Steritalc (Talc), Sterecyst (Prednimustine), Stivarga (Regorafenib), Sunitinib Malate, Supprelin LA (Histrelin), Sutent (Sunitinib Malate), Sutent (Sunitinib), Synribo (Omacetaxine Mepesuccinate), Tabloid (Thioguanine), TAC, Tafinlar (Dabrafenib), Tagrisso (Osimertinib), Talc, Talimogene Laherparepvec, Tamoxifen Citrate, Tarabine PFS (Cytarabine), Tarceva (Erlotinib), Targretin (Bexarotene), Tasigna (Decarbazine), Tasigna (Nilotinib), Taxol (Paclitaxel), Taxotere (Docetaxel), Temodar (Temozolomide), Temozolomide, Temsirolimus, Tepadina (Thiotepa), Thalidomide, Thalomid (Thalidomide), TheraCys BCG (BCG), Thioguanine, Thioplex (Thiotepa), Thiotepa, TICE BCG (BCG), Tisagenlecleucel, Tolak (Fluorouracil—Topical), Toposar (Etoposide), Topotecan Hydrochloride, Toremifene, Torisel (Temsirolimus), Totect (Dexrazoxane Hydrochloride), TPF, Trabectedin, Trametinib, Treanda (Bendamustine hydrochloride), Trelstar (Triptorelin), Trexall (Methotrexate), Trifluridine and Tipiracil Hydrochloride, Trisenox (Arsenic trioxide), Tykerb (lapatinib), Uridine Triacetate, VAC, Valrubicin, Valstar (Valrubicin Intravesical), Valstar (Valrubicin), VAMP, Vandetanib, Vantas (Histrelin), Varubi (Rolapitant), VeIP, Velban (Vinblastine), Velcade (Bortezomib), Velsar (Vinblastine Sulfate), Vemurafenib, Venclexta (Venetoclax), Vepesid (Etoposide), Verzenio (Abemaciclib), Vesanoid (Tretinoin), Viadur (Leuprolide Acetate), Vidaza (Azacitidine), Vinblastine Sulfate, Vincasar PFS (Vincristine), Vincrex (Vincristine), Vincristine Sulfate, Vincristine Sulfate Liposome, Vinorelbine Tartrate, VIP, Vismodegib, Vistogard (Uridine Triacetate), Voraxaze (Glucarpidase), Vorinostat, Votrient (Pazopanib), Vumon (Teniposide), Vyxeos (Daunorubicin Hydrochloride and Cytarabine Liposome), W, Wellcovorin (Leucovorin Calcium), Wellcovorin IV (Leucovorin), Xalkori (Crizotinib), XELIRI, Xeloda (Capecitabine), XELOX, Xofigo (Radium 223 Dichloride), Xtandi (Enzalutamide), Yescarta (Axicabtagene Ciloleucel), Yondelis (Trabectedin), Zaltrap (Ziv-Aflibercept), Zanosar (Streptozocin), Zarxio (Filgrastim), Zejula (Niraparib), Zelboraf (Vemurafenib), Zinecard (Dexrazoxane Hydrochloride), Ziv-Aflibercept, Zofran (Ondansetron Hydrochloride), Zoladex (Goserelin), Zoledronic Acid, Zolinza (Vorinostat), Zometa (Zoledronic acid), Zortress (Everolimus), Zydelig (Idelalisib), Zykadia (Ceritinib), Zytiga (Abiraterone Acetate), and Zytiga (Abiraterone).

In embodiments, the chemotherapy is a hormonal therapy. Illustrative hormone therapeutics include aromatase inhibitors, e.g., Letrozole, anastrozole, exemestane, aminoglutethimide; gonadotropin-releasing hormone (GnRH) analogues, e.g., leuprorelin and goserelin; hormone receptor antagonists, e.g., selective estrogen receptor modulators (as examples, tamoxifen, raloxifene, toremifene and fulvestrant) and antiandrogens, e.g., flutamide and bicalutamide; and hormone supplementation, e.g., megestrol acetate, medroxyprogesterone acetate, fluoxymesterone, diethylstilbestrol, estrace, polyestradiol phosphate, and octreotide.

In aspects and embodiments, the anti-cancer therapy is an immuno-oncology therapy. An immuno-oncology therapy comprises at least one molecule capable of binding and/or recognizing a tumor-cell antigen and/or a cancer-cell antigen. Examples, tumor-cell antigens and/or a cancer-cell antigens include but are not limited to, carbonic anhydrase IX (CAIX), 5T4, CD19, CD20, CD22, CD30, CD33, CD38, CD47, CS1, CD138, Lewis-Y, L1-CAM, MUC16, ROR-1, IL13Rα2, gp100, prostate stem cell antigen (PSCA), prostate-specific membrane antigen (PSMA), B-cell maturation antigen (BCMA), human papillomavirustype 16 E6 (HPV-16 E6), CD171, folate receptor alpha (FR-α), GD2, human epidermal growth factor receptor 2 (HER2), mesothelin, EGFRvIII, fibroblast activation protein (FAP), carcinoembryonic antigen (CEA), and vascular endothelial growth factor receptor 2 (VEGF-R2), as well as other tumor antigens well known in the art. Additional illustrative tumor antigens include, but are not limited to MART-1/Melan-A, gp100, Dipeptidyl peptidase IV (DPPIV), adenosine deaminase-binding protein (ADAbp), cyclophilin b, Colorectal associated antigen (CRC)-0017-1A/GA733, Carcinoembryonic Antigen (CEA) and its immunogenic epitopes CAP-1 and CAP-2, etv6, aml1, Prostate Specific Antigen (PSA) and its immunogenic epitopes PSA-1, PSA-2, and PSA-3, T-cell receptor/CD3-zeta chain, MAGE-family of tumor antigens (e.g., MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-C5), GAGE-family of tumor antigens (e.g., GAGE-1, GAGE-2, GAGE-3, GAGE-4, GAGE-5, GAGE-6, GAGE-7, GAGE-8, GAGE-9), BAGE, RAGE, LAGE-1, NAG, GnT-V, MUM-1, CDK4, tyrosinase, p53, MUC family, HER2/neu, p21ras, RCAS1, α-fetoprotein, E-cadherin, α-catenin, β-catenin and γ-catenin, p120ctn, gp100 Pmel117, PRAME, NY-ESO-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, Imp-1, NA, EBV-encoded nuclear antigen (EBNA)-1, brain glycogen phosphorylase, SSX-1, SSX-2 (HOM-MEL-40), SSX-1, SSX-4, SSX-5, SCP-1 CT-7, c-erbB-2, CD19, CD37, CD56, CD70, CD74, CD138, AGS16, MUC1, GPNMB, Ep-CAM, PD-L1, and PD-L2.

In embodiments, the tumor-cell antigen and/or a cancer-cell antigen is a checkpoint molecule. The checkpoint molecule may be a stimulatory checkpoint molecule, e.g., CD27, CD28, CD40, CD122, CD137, OX40, GITR, and ICOS. The checkpoint molecule may be an inhibitory checkpoint molecule, e.g., 2B4, A2AR, B-7 family ligands (including, but are not limited to, B7-1, B7-2, B7-DC, B7-H1, B7-H2, B7-H3, B7-H4, B7-H5, B7-H6 and B7-H7), BTLA, CD115, CD160/By55, CD172a/SIRPα, CD200, CD223, CD244, CEACAM, CHK 1 and CHK2 kinases, CTLA-4, GAL9, HVEM, IDO, KIR, LAG3, PD-1, PD-L1, PD-L2, TIGIT, TIM-3, TMIGD2, and VISTA/VSIG8.

In embodiments, the immuno-oncology therapy is protein-based, e.g., antibody, fusion protein, and/or cytokine.

In embodiments, the antibody is Adcetris (Brentuximab Vedotin), Ado-Trastuzumab Emtansine, Alemtuzumab, Arzerra (Ofatumumab), Atezolizumab, Avastin (Bevacizumab), Avelumab, Bavencio (Avelumab), Besponsa (Inotuzumab Ozogamicin), Bevacizumab, Bexxar (Tositumomab), Blinatumomab, Blincyto (Blinatumomab), BMS 936559, Brentuximab Vedotin, Campath (Alemtuzumab), Cetuximab, Cinqair (Reslizumab), Cyramza (Ramucirumab), Daratumumab, Darzalex (Daratumumab), Denosumab, Dinutuximab, Durvalumab, Elotuzumab, Empliciti (Elotuzumab), Erbitux (Cetuximab), Folfiri-Bevacizumab, Folfiri-Cetuximab, Gazyva (Obinutuzumab), Gemtuzumab Ozogamicin, Herceptin (Trastuzumab), Ibritumomab Tiuxetan, Imfinzi (Durvalumab), Inotuzumab Ozogamicin, Ipilimumab, Kadcyla (Ado-trastuzumab Emtansine), Keytruda (Pembrolizumab), Lartruvo (Olaratumab), MK-3475, MPDL3280A, Mylotarg (Gemtuzumab Ozogamicin), Necitumumab, Nivolumab, Obinutuzumab, Ofatumumab, Olaratumab, Opdivo (Nivolumab), Panitumumab, Perjeta (Pertuzumab), Pertuzumab, Pembrolizumab, Pidilizumab, Portrazza (Necitumumab), Prolia (Denosumab), Ramucirumab, Rituxan (Rituximab), Rituximab and Hyaluronidase Human, Siltuximab, Sylvant (Siltuximab), Tecentriq (Atezolizumab), Trastuzumab, Unituxin (Dinutuximab), Vectibix (Panitumumab), Xgeva (Denosumab), Yervoy (Ipilimumab), and Zevalin (Ibritumomab Tiuxetan).

In embodiments, the immuno-oncology therapy includes an engineered protein or a fusion protein. In embodiments, the engineered protein or fusion protein binds to one or more tumor-cell antigens and/or cancer-cell antigens. In embodiments, the fusion protein binds to one or more tumor-cell antigens and/or cancer-cell antigens and is conjugated to a chemotherapeutic agent (as described herein).

In embodiments, the immuno-oncology therapy includes a cytokine, e.g., which binds to one or more tumor-cell antigens and/or cancer-cell antigens. In embodiments, the cytokine is Interferon Alfa-2b, Interleukin-2 (Aldesleukin), Intron A alfab (Interferon alfa-2a), Peginterferon Alfa-2b, PEG-Intron (Peginterferon Alfa-2b), Recombinant Interferon Alfa-2b, RoferonA alfaa (Interferon alfa-2a), and Sylatron (Peginterferon Alfa-2b).

In embodiments, binding and/or recognizing a tumor-cell antigen and/or a cancer-cell antigen blocks and/or prevents downstream signaling of the tumor-cell antigen and/or cancer-cell antigen. Alternately, binding and/or recognizing a tumor-cell antigen and/or a cancer-cell antigen activates and/or stimulates downstream signaling of the tumor-cell antigen and/or cancer-cell antigen.

In embodiments, the immuno-oncology therapy is a cell-based immuno-oncology therapy, e.g., relating to adoptive cell transfer (ACT). The ACT may be autologous or allogenic.

In embodiments, the cell-based immuno-oncology therapy comprises use of Chimeric Antigen Receptor (CAR) T-cell. Exemplary CAR T-cell therapy include, but are not limited to, JCAR014 (Juno Therapeutics), JCAR015 (Juno Therapeutics), JCAR017 (Juno Therapeutics), JCAR018 (Juno Therapeutics), JCAR020 (Juno Therapeutics), JCAR023 (Juno Therapeutics), JCAR024 (Juno Therapeutics), CTL019 (Novartis), Kymriah (or tisagenlecleucel; Novartis), KTE-C19 (Kite Pharma), BPX-401 (Bellicum Pharmaceuticals), BPX-501 (Bellicum Pharmaceuticals), BPX-601 (Bellicum Pharmaceuticals), bb2121 (Bluebird Bio), CD-19 Sleeping Beauty cells (Ziopharm Oncology), UCART19 (Cellectis), UCART123 (Cellectis), UCART38 (Cellectis), UCARTCS1 (Cellectis), OXB-302 (Oxford Bio-Medica, MB-101 (Mustang Bio), and CAR T-cells developed by Innovative Cellular Therapeutics.

In embodiments, the cell-based immuno-oncology therapy comprises use of an antigen-presenting cell (APC). In embodiments, the APC-related therapy comprises use of dendritic cells or other APCs that express tumor-cell antigens or cancer-cell antigens (as described herein). In one example, the APC is Sipuleucel-T (APC8015, trade name Provenge; Dendreon Corporation).

In embodiments, the cell-based immuno-oncology therapy comprises use of engineered T Cell Receptors (TCR) which recognize tumor-cell antigens or cancer-cell antigens (as described herein).

In embodiments, the cell-based immuno-oncology therapy comprises use of tumor infiltrating lymphocytes (TIL), e.g., adoptive transfer of TILs, which recognize tumor-cell antigens or cancer-cell antigens (as described herein).

In various embodiments, the methods of the present invention may stimulate and/or activate Toll-like receptor activity (e.g., TLR1, and/or TLR2, and/or TLR3, and/or TLR4, and/or TLR5, and/or TLR6, and/or TLR7, and/or TLR8, and/or TLR9, and/or TLR10, and/or TLR11, and/or TLR12, and/or TLR13).

In various embodiments, the methods of the present invention treat or prevent catheter or intravascular-line infections (e.g., central-line infections), chronic inflammatory diseases, meningitis, pneumonia, e.g., ventilator-associated pneumonia, skin and soft tissue infections, surgical-site infections, urinary tract infections (e.g., antibiotic-resistant urinary tract infections and catheter-associated urinary tract infections), wound infections, and other well-known infections: antibiotic-resistant infections and antibiotic-sensitive infections.

In various embodiments, the methods of the present invention treat or prevent the various GI disorders disclosed herein and/or as known in the art to be a result of gut dysbiosis.

In various embodiments, the methods of the present invention reduce GI immunoactivation and inflammation.

In various embodiments, the methods of the present invention treat or prevent various bloodstream infections (BSI). Patients at risk for such BSI include but are not limited to Solid organ transplant patients; Chronic kidney disease patients, e.g., on hemodialysis; and oncology patients. Patients at risk for such BSI also include patients who are in an outpatient setting, hospitalized, or in long-term care facilities.

In various embodiments, the methods of the present invention treat or prevent various inflammatory disorders. Inflammatory disorders include but are not limited to Inflammatory bowel disease (Ulcerative colitis and Crohn's disease); Irritable bowel syndrome; Metabolic disease/Insulin resistance (Type II diabetes); and Rheumatoid arthritis.

In various embodiments, the methods of the present invention reduce, ameliorate, or eliminate one or more symptom(s) associated with a herein-described disease, disorder, or condition. Exemplary symptoms include, but are not limited to, diarrhea, bloody stool, mouth sores, perianal disease, abdominal pain, abdominal cramping, fever, fatigue, weight loss, iron deficiency, anemia, appetite loss, weight loss, anorexia, delayed growth, delayed pubertal development, and inflammation of the skin, eyes, joints, liver, and bile ducts.

In one aspect, a method comprises administering a therapeutic composition orally, by enema, or via rectal suppository. In one aspect, a pharmaceutical composition is formulated as a geltab, pill, microcapsule, capsule, or tablet. In one aspect, a therapeutic composition is formulated as an enteric coated capsule or microcapsule, acid-resistant capsule or microcapsule, or formulated as part of or administered together with a food, a food additive, a dairy-based product, a soy-based product or a derivative thereof, a jelly, or a yogurt. In another aspect, a therapeutic composition is formulated as an acid-resistant enteric coated capsule. A therapeutic composition can be provided as a powder for sale in combination with a food or drink. A food or drink can be a dairy-based product or a soy-based product. In another aspect, a food or food supplement contains enteric-coated and/or acid-resistant microcapsules containing a therapeutic composition.

Any aspect or embodiment disclosed herein can be combined with any other aspect or embodiment as disclosed herein.

Definitions

As used herein, "isolated" or "purified" refers to a bacterium or other entity or substance that has been (1) separated from at least some of the components with which it was associated when initially produced (whether in nature or in an experimental setting), and/or (2) produced, prepared, purified, and/or manufactured by the hand of man. Isolated or purified bacteria can be separated from at least about 10%, about 20%, about 30%, about 40%, about 50%, about 60%, about 70%, about 80%, about 90%, or more of the other components with which they were initially associated.

As used herein, "microbiota," and "flora" refer to a community of microbes that live in or on a subject's body, both sustainably and transiently, including eukaryotes, archaea, bacteria, and viruses (including bacterial viruses (i.e., phage)). A non-selected fecal microbiota refers to a community or mixture of fecal microbes derived from a donor's fecal sample without selection and substantially resembling microbial constituents and population structure found in such fecal sample.

As used herein, "gut dysbiosis" refers to an imbalance, maladaptation, and/or reduced diversity in the microbiota in a subject's digestive system. For example, a part of the gutflora is unbalanced, with normally dominating species, i.e., beneficial bacteria, becoming underrepresented (and/or less metabolically active) and outcompeted by contained species, e.g., pathogenic and/or antibiotic-resistant bacteria, which proliferate to fill the void.

As used herein, examples of a "side effect of an anti-cancer therapeutic agent" and a "side effect of an anti-cancer therapy" include abdominal pain, anemia and low blood counts, appetite loss, autoimmune effects, bleeding and bruising (thrombocytopenia), cancer, changes in mood or thinking, colonization by pathogenic bacteria, constipation, cough, dehydration, delirium, diabetes-related symptoms, diarrhea, dry mouth or xerostomia, eating problems, edema, falling, fatigue, fertility issues, fever, flu-like symptoms, fluid in the abdomen or ascites, gastrointestinal (GI) mucositis, gut dysbiosis, hair loss (alopecia), hand-foot syndrome or palmar-plantar erythrodysesthesia, headache, hearing problems, high or low blood pressure, hormone changes, hiccups, hypercalcemia, infection and neutropenia, infection by pathogenic bacteria, inflammatory bowel disease, irritable bowel syndrome, leg cramps, lymphedema, memory or concentration problems, mouth and throat problems, nausea and vomiting, nerve problems (peripheral neuropathy), obesity, osteoporosis, ostomies, pain, seizures, sexual health issues, shortness of breath, sinus congestion, skin and nail changes, sleep problems, stool or urine changes, sweating, swelling, ulcerative colitis, urinary and bladder problems, weight gain from retaining fluid, and/or weakness. In embodiments, a side effect of the anti-cancer therapeutic agent and/or anti-cancer therapy is caused by gut dysbiosis; it has been reported that chemotherapy, for example, is associated with reduced diversity in the gut microbiome. Thus, "treating or preventing or reducing a side effect" refers to decreasing the severity of a side effect and up to eliminating the side effect, e.g., in part, by repairing/repopulating his/her gut microbiome after receiving the anti-cancer therapeutic agent and/or anti-cancer therapy.

As used herein, "increase[ing] efficacy of an anti-cancer therapeutic agent and/or anti-cancer therapy" refers to the ability of a microbial composition or method using same to promote the beneficial and desired effects of an anti-cancer therapeutic agent and/or anti-cancer therapy, i.e., killing cancer cells, reducing tumor size, and/or simulating an immune response against a cancer cell or tumor.

As used herein, "spore" or a population of "spores" includes bacteria (or other single-celled organisms) that are generally viable, more resistant to environmental influences such as heat and bactericidal agents than vegetative forms of the same bacteria, and typically capable of germination and out-growth. "Spore-formers" or bacteria "capable of forming spores" are those bacteria containing the genes and other necessary abilities to produce spores under suitable environmental conditions.

In embodiments, the subject, e.g., a human, is refractory and/or non-responsive to a treatment directed to a checkpoint molecule. In embodiments, the treatment directed to a checkpoint molecule comprises administration of Keytruda (Pembrolizumab), Opdivo (Nivolumab), Yervoy (Ipilimumab), Tecentriq (atezolizumab), Bavencio (avelumab), or Imfinzi (durvalumab).

As used herein, the term "treating" refers to (i) completely or partially inhibiting a disease, disorder or condition, for example, arresting its development; (ii) completely or partially relieving a disease, disorder or condition, for example, causing regression of the disease, disorder and/or condition; or (iii) completely or partially preventing a disease, disorder or condition from occurring in a patient that may be predisposed to the disease, disorder and/or condition, but has not yet been diagnosed as having it. Similarly, "treatment" refers to both therapeutic treatment and prophylactic or preventative measures.

As used herein, the term "substantially", when used to modify a quality, generally allows certain degree of variation without that quality being lost. For example, in certain aspects such degree of variation can be less than 0.1%, about 0.1%, about 0.2%, about 0.3%, about 0.4%, about 0.5%, about 0.6%, about 0.7%, about 0.8%, about 0.9%, about 1%, between 1-2%, between 2-3%, between 3-4%, between 4-5%, or greater than 5%.

In some embodiments, the terms "patient" and "subject" are used interchangeably. In some embodiments, the subject and/or animal is a mammal, e.g., a human, mouse, rat, guinea pig, dog, cat, horse, cow, pig, rabbit, sheep, or non-human primate, such as a monkey, chimpanzee, or baboon. In other embodiments, the subject and/or animal is a non-mammal, such, for example, a zebrafish.

In various embodiments, methods of the invention are useful in treatment a human subject. In some embodiments, the human is a pediatric human. In other embodiments, the human is an adult human. In other embodiments, the human is a geriatric human. In other embodiments, the human may be referred to as a patient. In some embodiments, the human is a female. In some embodiments, the human is a male.

In certain embodiments, the human has an age in a range of from about 1 to about 18 months old, from about 18 to about 36 months old, from about 1 to about 5 years old, from about 5 to about 10 years old, from about 10 to about 15 years old, from about 15 to about 20 years old, from about 20 to about 25 years old, from about 25 to about 30 years old, from about 30 to about 35 years old, from about 35 to about 40 years old, from about 40 to about 45 years old, from about 45 to about 50 years old, from about 50 to about 55 years old, from about 55 to about 60 years old, from about 60 to about 65 years old, from about 65 to about 70 years old, from about 70 to about 75 years old, from about 75 to about 80 years old, from about 80 to about 85 years old, from about 85 to about 90 years old, from about 90 to about 95 years old or from about 95 to about 100 years old.

As used in this Specification and the appended claims, the singular forms "a," "an" and "the" include plural referents unless the context clearly dictates otherwise.

Unless specifically stated or obvious from context, as used herein, the term "or" is understood to be inclusive and covers both "or" and "and".

Unless specifically stated or obvious from context, as used herein, the term "about" is understood as within a range of normal tolerance in the art, for example within (plus or minus) 10%, 9%, 8%, 7%, 6%, 5%, 4%, 3%, 2%, 1%, 0.5%, 0.1%, 0.05%, or 0.01% of the stated value.

The terms "one or more", "at least one", and the like are understood to include but not be limited to at least 1, 2, 3, 4, 5, 6, 7, 8, 9, 10, 11, 12, 13, 14, 15, 16, 17, 18, 1920, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149 or 150, 200, 300, 400, 500, 600, 700, 800, 900, 1000, 2000, 3000, 4000, 5000 or more and any number in between.

Conversely, the term "no more than" includes each value less than the stated value.

The terms "plurality", "at least two", "two or more", "at least second", and the like, are understood to include but not limited to at least 2, 3, 4, 5, 6, 7, 8, 9, 10, 11, 12, 13, 14, 15, 16, 17, 18, 19 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149 or 150, 200, 300, 400, 500, 600, 700, 800, 900, 1000, 2000, 3000, 4000, 5000 or more and any number in between.

The term "greater than" and the like, is understood to include values greater than the stated by at least 1, 2, 3, 4, 5, 6, 7, 8, 9, 10, 11, 12, 13, 14, 15, 16, 17, 18, 1920, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149 or 150, 200, 300, 400, 500, 600, 700, 800, 900, 1000, 2000, 3000, 4000, 5000 or more and any number in between.

A stated range is understood to be any value between and at the limits of the stated range. As examples, a range between 1 and 5 includes 1, 2, 3, 4, and 5; a range between 1 and 10 includes 1, 2, 3, 4, 5, 6, 7, 8, 9, and 10; and a range between 1 and 100 includes 1, 2, 3, 4, 5, 6, 7, 8, 9, 10, 11, 12, 13, 14, 15, 16, 17, 18, 19 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100.

Unless defined otherwise, all technical and scientific terms used herein have the same meaning as commonly understood by one of ordinary skill in the art to which the invention pertains. Although other probes, compositions, methods, and kits similar, or equivalent, to those described herein can be used in the practice of the present invention, the preferred materials and methods are described herein. It is to be understood that the terminology used herein is for the purpose of describing particular embodiments only, and is not intended to be limiting.

EXAMPLES

Example 1: Determination of Useful Bacteria in a Bacterial Mixture of the Present Invention Tables 5 and 6 (above) are the result of analyses using 16S rRNA sequencing data from public and private sources to identify bacterial strains that help maintain and restore the gut barrier.

Some of the operational taxonomic units (OTUs) were identified because they are present in healthy stool donors and the family or genus they belong to was enriched in patients who did not develop an Enterococcal bloodstream infection (BSI) compared to those who developed an Enterococcal BSI; in a receiver operator curve (ROC) plot, the AUC was greater than or equal to 0.6, showing that the presence/absence of these families and genera can predict whether a patient will develop an Enterococcal BSI. Some of the OTUs were identified because they are present in healthy stool donors and the family or genus they belong to was at least 2-fold enriched in patients receiving chemotherapy who did not develop a BSI compared to those who developed a BSI; in a ROC plot, the AUC was greater than or equal to 0.6, showing that the presence/absence of these families and genera can predict whether a patient will develop a BSI. Some of the OTUs were identified because they are present in healthy stool donors and the family or genus they belong to was enriched in patients who did not develop a BSI caused by Gram negative bacteria compared to those who developed a BSI caused by a Gram negative bacteria; in a ROC plot, the AUC was greater than or equal to 0.6, showing that the presence/absence of these families and genera can predict whether a patient will develop BSI caused by Gram negative bacteria. Patients had received or were undergoing stem cell transplantation as part of a treatment for leukemia, lymphoma, multiple myeloma or myelodysplastic syndrome.

Three datasets used in these analyses: (1) Taur Y, Xavier J, Lipuma L, Carles Ubeda, Goldberg J, Gobourne A, Lee Y, Dubin K, Socci N, Viale A, Perales M-A, Jenq R, Brink M, Pamer E. Intestinal Domination and the Risk of Bacteremia in Patients Undergoing Allogeneic Hematopoietic Stem Cell Transplantation. Clin Infect Dis. 2012; 55(7):905-914. PMCID: PMC3657523; (2) Montassier E, Al-Ghalith G A, Ward T, Corvec S, Gastinne T, Potel G, Moreau P, de la Cochetiere M F, Batard E, Knights D. Pretreatment gut microbiome predicts chemotherapy-related bloodstream infection. Genome Medicine. 2016; 8:49; and (3) 16S sequencing was performed on samples from 63 of the healthy and extensively-screened stool donors.

FIG. 1 is a pie chart showing percentage of all OTUs in the GreenGenes database that are found in a healthy human gut and that are included in Table 5. The GreenGenes database contains sequence data corresponding to almost 100,000 unique 16S sequences from different bacterial strains that have been sequenced. See, the World Wide Web (www) at greengenes.lbl.gov. FIG. 1 shows the fraction of all OTUs found in the GreenGenes database that are found in the human gut and that are relevant to the present invention. As shown in FIG. 1, 94.6%, of all OTUs in the GreenGenes database are not found in the healthy human gut; 5.1% of all OTUs in the GreenGenes database are found in the healthy human gut; and 0.3% of all OTUs in the GreenGenes database that are listed in Table 5.

Example 2. Development of Bacterial Mixtures

A product candidate is being developed which includes a novel mixture of commensal bacterial strains that protect, maintain, and/or restore the integrity of the gut barrier, e.g., before, during, and/or after receiving the anti-cancer therapy.

Bacterial strains may be included in a mixture based on their abundance in donors whose stool was used for successful fecal microbiota transplants (FMTs) in a patient suffering from a gut dysbiosis disorder, e.g., caused by a previous or current anti-cancer therapy. Additionally, bacterial strains may be included in a mixture due to their ability to activate Toll-Like Receptors (TLRs), which modulate the production of antimicrobial peptides, which target many human bacterial pathogens, to complement the capacity of a functionally deficient microbial community (e.g., the microbial community of a patient infected and/or colonized by a pathogenic bacteria) to produce levels of SCFAs comparable to healthy individuals, to directly inhibit a pathogenic bacterium through production of a secreted product, to enable mucosal healing, improve mucosal barrier function, and/or to reduce inflammation, to enhance production of SCFAs, to help maintain and/or repair a deficient gut barrier, to induce a thickening of the colonic epithelial mucus, to induce an increase in antimicrobial peptide production, to induce an increase in IgA production, to induce improved tight junction integrity, and/or to promote restoration of mucosal barrier functions.

Certain bacterial strains are included in a mixture based upon their 16S rRNA sequence identity. For example, the mixture includes one or more bacterial strains having a 16S rRNA sequence that is at least about 80% identical to the 16S rRNA sequence of any one of the operational taxonomic units (OTUs) provided in Table 5 or Table 6. For example, the mixture may include one or more bacterial strains having a 16S rRNA sequence that is at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100% identical with the 16S rRNA sequence of any one of the operational taxonomic units (OTUs) provided in Table 5 or Table 6.

Certain mixtures of bacterial strains are substantially complete fecal microbiota preparations, which generally comprises a full complement of functional microorganisms found in feces of one or more healthy humans (e.g., a single healthy stool donor). Such mixtures of bacterial strains may be supplemented with one or more strains listed in Table 5 or Table 6 and/or one or more strains having a 16S rRNA sequence that is at least about 95% identical with the 16S rRNA sequence of any one of the strains listed in Table 5 or Table 6.

Other mixtures of bacterial strains comprise "less than the full complement" of functional microorganisms found in feces of one healthy human or in feces of more than one healthy human donor. These bacterial mixtures omit at least one bacterial strain from the full complement. Such mixtures of bacterial strains may be supplemented with one or more strains listed in Table 5 or Table 6 and/or one or more strains having a 16S rRNA sequence that is at least about 95% identical with the 16S rRNA sequence of any one of the strains listed in Table 5 or Table 6.

Some bacterial strains in a mixture are directly obtained from human feces (i.e., from a suitable and healthy donor); Some of those strains may isolated or purified from its source material, i.e., separated from at least some of the components with which they were associated when initially produced (e.g., nature (from feces)) Some bacterial strains in a mixture are indirectly obtained from human feces and/or are obtained independent of human feces (e.g., from a bacterial cell bank or from a laboratory stock).

Example 3: Production of a Pharmaceutical Composition

Strains selected in Example 1 and/or Example 2 may be independently cultured and mixed together before administration. Cultured strains are independently grown in supportive media, e.g. at 37° C., pH 7, in a GMM or other animal-products-free medium, pre-reduced with 1 g/L cysteine-HCl. After each strain reaches a sufficient biomass, it is optionally preserved for banking by adding 15% glycerol and then frozen at −80° C. in 1 ml cryotubes.

Each strain may then be cultivated to a concentration of about $10^{10}$ CFU/mL, then concentrated 20-fold by tangential flow microfiltration; the spent medium is exchanged by diafiltering with a preservative medium consisting of 2% gelatin, 100 mM trehalose, and 10 mM sodium phosphate buffer, or other suitable preservative medium. The suspension is freeze-dried to a powder and titrated.

After drying, the powder is blended with microcrystalline cellulose and magnesium stearate and formulated into a 250 mg gelatin capsule containing 10 mg of lyophilized powder ($10^8$ to $10^{11}$ bacteria), 160 mg microcrystalline cellulose, 77.5 mg gelatin, and 2.5 mg magnesium stearate.

Example 4: Methods of Treatment

A subject having gut dysbiosis is administered a pharmaceutical composition comprising a bacterial mixture of the present invention to treat the gut dysbiosis.

For subjects who have gut dysbiosis as a side effect of an anti-cancer therapeutic agent and/or a side effect of an anti-cancer therapy, the pharmaceutical composition helps reduce or treating the side effect.

For subjects who have undergone or are undergoing an anti-cancer therapeutic agent and/or a side effect of an anti-cancer therapy, the pharmaceutical composition increases the efficacy of the anti-cancer therapeutic agent and/or anti-cancer therapy.

Example 5: Methods of Prevention

A subject at risk for gut dysbiosis is administered a pharmaceutical composition comprising a bacterial mixture of the present invention to prevent gut dysbiosis.

For subjects who are at risk for gut dysbiosis as a side effect of an anti-cancer therapeutic agent and/or a side effect of an anti-cancer therapy, the pharmaceutical composition helps prevents the likelihood of getting the side effect.

EQUIVALENTS

While the invention has been described in connection with specific embodiments thereof, it will be understood that it is capable of further modifications and this application is intended to cover any variations, uses, or adaptations of the invention following, in general, the principles of the invention and including such departures from the present disclosure as come within known or customary practice within the art to which the invention pertains and as may be applied to the essential features hereinbefore set forth and as follows in the scope of the appended claims.

Those skilled in the art will recognize, or be able to ascertain, using no more than routine experimentation, numerous equivalents to the specific embodiments described specifically herein. Such equivalents are intended to be encompassed in the scope of the following claims.

REFERENCES

1. Bischoff S C, Barbara G, Buurman W, Ockhuizen T, Schulzke J-D, Serino M, Tilg H, Watson A, Wells J M. Intestinal permeability—a new target for disease prevention and therapy. BMC Gastroenterol [Internet]. 2014 Nov. 18 [cited 2017 May 8]; 14. Available from: ncbi.nlm.nih.gov/pmc/articles/PMC4253991/PMCID: PMC4253991
2. Brandtzaeg P. The gut as communicator between environment and host: immunological consequences. Eur J Pharmacol. 2011 September; 668 Suppl 1:S16-32. PMID: 21816150
3. Michielan A, D'Incà R. Intestinal Permeability in Inflammatory Bowel Disease: Pathogenesis, Clinical Evaluation, and Therapy of Leaky Gut. Mediators Inflamm [Internet]. 2015 [cited 2017 Feb. 4]; 2015. Available from: the World Wide Web (www) at ncbi.nlm.nih.gov/pmc/articles/PMC4637104/PMCID: PMC4637104
4. Acosta A, Camilleri M, Shin A, Linker Nord S, O'Neill J, Gray A V, Lueke A J, Donato L J, Burton D D, Szarka L A, Zinsmeister A R, Golden P L, Fodor A. Effects of Rifaximin on Transit, Permeability, Fecal Microbiome, and Organic Acid Excretion in Irritable Bowel Syndrome. Clin Transl Gastroenterol. 2016 May 26; 7(5):e173.
5. Thuy S, Ladurner R, Volynets V, Wagner S, Strahl S, Königsrainer A, Maier K-P, Bischoff S C, Bergheim I. Nonalcoholic fatty liver disease in humans is associated with increased plasma endotoxin and plasminogen activator inhibitor 1 concentrations and with fructose intake. J Nutr. 2008 August; 138(8):1452-1455. PMID: 18641190

6. Seki E, Schnabl B. Role of innate immunity and the microbiota in liver fibrosis: crosstalk between the liver and gut. J Physiol. 2012 Feb. 1; 590(Pt 3):447-458. PMCID: PMC3379693
7. Lin R, Zhou L, Zhang J, Wang B. Abnormal intestinal permeability and microbiota in patients with autoimmune hepatitis. Int J Clin Exp Pathol. 2015 May 1; 8(5):5153-5160. PMCID: PMC4503083
8. Andersen K, Kesper M S, Marschner J A, Konrad L, Ryu M, Kumar Vr S, Kulkarni O P, Mulay S R, Romoli S, Demleitner J, Schiller P, Dietrich A, Müller S, Gross O, Ruscheweyh H-J, Huson D H, Stecher B, Anders H-J. Intestinal Dysbiosis, Barrier Dysfunction, and Bacterial Translocation Account for CKD-Related Systemic Inflammation. J Am Soc Nephrol JASN. 2017 January; 28(1):76-83. PMID: 27151924
9. Serino M, Luche E, Gres S, Baylac A, Berge M, Cenac C, Waget A, Klopp P, Iacovoni J, Klopp C, Mariette J, Bouchez O, Lluch J, Ouarné F, Monsan P, Valet P, Roques C, Amar J, Bouloumié A, Théodorou V, Burcelin R. Metabolic adaptation to a high-fat diet is associated with a change in the gut microbiota. Gut. 2012 April; 61(4): 543-553. PMCID: PMC3292714
10. Melichar B, Zezulová M. The significance of altered gastrointestinal permeability in cancer patients. Curr Opin Support Palliat Care. 2011 March; 5(1):47-54. PMID: 21326003
11. Pretorius E, Mbotwe S, Bester J, Robinson C J, Kell D B. Acute induction of anomalous and amyloidogenic blood clotting by molecular amplification of highly substoichiometric levels of bacterial lipopolysaccharide. J R Soc Interface. 2016 Sep. 1; 13(122):20160539. PMID: 27605168
12. Campbell A W. Autoimmunity and the Gut. Autoimmune Dis [Internet]. 2014 [cited 2017 May 8]; 2014. Available from: the World Wide Web (www) at ncbi.nlm.nih.gov/pmc/articles/PMC4036413/PMCID: PMC4036413
13. Schuijt T J, Lankelma J M, Scicluna B P, de Sousa e Melo F, Roelofs J J T H, de Boer J D, Hoogendijk A J, de Beer R, de Vos A, Belzer C, de Vos W M, van der Poll T, Wiersinga W J. The gut microbiota plays a protective role in the host defence against pneumococcal pneumonia. Gut. 2016 April; 65(4):575-583. PMCID: PMC4819612
14. Desai M S, Seekatz A M, Koropatkin N M, Kamada N, Hickey C A, Wolter M, Pudlo N A, Kitamoto S, Terrapon N, Muller A, Young V B, Henrissat B, Wilmes P, Stappenbeck T S, Núñez G, Martens E C. A Dietary Fiber-Deprived Gut Microbiota Degrades the Colonic Mucus Barrier and Enhances Pathogen Susceptibility. Cell. 2016 Nov. 17; 167(5):1339-1353.e21.
15. Wlodarska M, Willing B, Keeney K M, Menendez A, Bergstrom K S, Gill N, Russell S L, Vallance B A, Finlay B B. Antibiotic Treatment Alters the Colonic Mucus Layer and Predisposes the Host to Exacerbated *Citrobacter rodentium*-Induced Colitis. Infect Immun. 2011 Apr. 1; 79(4):1536-1545. PMID: 21321077
16. Zhao J, Nian L, Kwok L Y, Sun T, Zhao J. Reduction in fecal microbiota diversity and short-chain fatty acid producers in Methicillin-resistant *Staphylococcus aureus* infected individuals as revealed by PacBio single molecule, real-time sequencing technology. Eur J Clin Microbiol Infect Dis Off Publ Eur Soc Clin Microbiol. 2017 Apr. 28; PMID: 28455781
17. Taur Y, Xavier J, Lipuma L, Carles Ubeda, Goldberg J, Gobourne A, Lee Y, Dubin K, Socci N, Viale A, Perales M-A, Jenq R, Brink M, Pamer E. Intestinal Domination and the Risk of Bacteremia in Patients Undergoing Allogeneic Hematopoietic Stem Cell Transplantation. Clin Infect Dis. 2012; 55(7):905-914. PMCID: PMC3657523
18. Earle K A, Billings G, Sigal M, Lichtman J S, Hansson G C, Elias J E, Amieva M R, Huang K C, Sonnenburg J L. Quantitative Imaging of Gut Microbiota Spatial Organization. Cell Host Microbe. 2015 Oct. 14; 18(4):478-488. PMID:26439864
19. Suzuki T, Yoshida S, Hara H. Physiological concentrations of short-chain fatty acids immediately suppress colonic epithelial permeability [Internet]. British Journal of Nutrition. 2008 [cited 2016 Sep. 21]. Available from: /core/journals/british-journal-of-nutrition/article/physiological-concentrations-of-short-chain-fatty-acids-immediately-suppress-colonic-epithelial-permeability/EBE53D3C9A914AF05A7933FE63D99825
20. Goverse G, Molenaar R, Macia L, Tan J, Erkelens M N, Konijn T, Knippenberg M, Cook E C L, Hanekamp D, Veldhoen M, Hartog A, Roeselers G, Mackay C R, Mebius R E. Diet-Derived Short Chain Fatty Acids Stimulate Intestinal Epithelial Cells To Induce Mucosal Tolerogenic Dendritic Cells. J Immunol. 2017 Jan. 18; 1600165. PMID: 28100682
21. Wu W, Sun M, Chen F, Cao A T, Liu H, Zhao Y, Huang X, Xiao Y, Yao S, Zhao Q, Liu Z, Cong Y. Microbiota metabolite short-chain fatty acid acetate promotes intestinal IgA response to microbiota which is mediated by GPR43. Mucosal Immunol [Internet]. 2016 Dec. 14 [cited 2017 Jan. 24]; Available from: the World Wide Web (www) at nature.com/doifinder/10.1038/mi.2016.114
22. Vaishnava S, Yamamoto M, Severson K M, Ruhn K A, Yu X, Koren O, Ley R, Wakeland E K, Hooper L V. The Antibacterial Lectin RegIIIγ Promotes the Spatial Segregation of Microbiota and Host in the Intestine. Science. 2011 Oct. 14; 334(6053):255-258. PMID: 21998396
23. Ubeda C, Bucci V, Caballero S, Djukovic A, Toussaint N, Equinda M, Lipuma L, Ling L, Gobourne A, No D, Taur Y, Jenq R, Brink M, Xavier J, Pamer E. Intestinal Microbiota Containing *Barnesiella* Species Cures Vancomycin-Resistant *Enterococcus faecium* Colonization. Infect Immun. 2013; 81(3):965-973. PMCID: PMC3584866
24. Kinnebrew M, Ubeda C, Zenewicz L, Smith N, Flavell R, Pamer E. Bacterial flagellin stimulates Toll-like receptor 5-dependent defense against vancomycin-resistant *Enterococcus* infection. J Infect Dis. 2010; 201(4):534-43. PMCID: PMC2811237
25. Olsan E E et al., Colonization resistance: the deconvolution of a complex trait. 2017. Journal of Biological Chemistry 292(21): 8577-8581.
26. Meynell G G. Antibacterial mechanisms of the mouse gut. II. The role of Eh and volative fatty acids in the normal gut. 1963. British journal of experimental pathology 44: 209-219.
27. Winter S E et al., The dynamics of gut-associated microbial communities during inflammation. 2013. EMPO Rep 14: 319-327.
28. Winter S E et al., Host-derived nitrate boosts growth of *E. coli* in the inflamed gut. 2013. Science 339: 708-711.
29. Spees A M et al., Streptomycin-induced inflammation enhances *Escherichia coli* gut colonization through nitrate respiration. 2013. MBio 4: e00430
30. Garner C D et al., Perturbation of the small intestine microbial ecology by streptomycin alters pathology in a

*Salmonella enterica* serovar *typhimurium* murine model of infection. 2009. Infection and Immunity 77: 2691-2702.

31. Smith P M et al., The microbial metabolites, short-chain fatty acids, regulate colonic Treg cell homeostasis. 2013. Science 341: 569-573.
32. Rivera-Chavez F et al., Depletion of butyrate-producing Clostridia from the gut microbiota drives an aerobic luminal expansion of *Salmonella*. 2016. Cell Host and Microbe 19: 443-454.
33. Itoh K and Freter R. Control of *Escherichia coli* populations by a combination of indigenous Clostridia and Lactobacilli in gnotobiotic mice and continuous-flow cultures. 1989. Infection and Immunity 57: 559-565.
34. Donohoe D R et al., Microbial regulation of glucose metabolism and cell-cycle progression in mammalian colonocytes. 2012. PLoS One 7: e46589.
35. Kelly C J et al., Crosstalk between microbiota-derived short-chain fatty acids and intestinal epithelial HIF augments tissue barrier function. 2015. Cell Host and Microbe 17: 662-671.
36. Jones S A et al., Anaerobic respiration of *Escherichia coli* in the mouse intestine. 2011. Infection and Immunity 79: 4218-4226.
37. Kinnebrew M et al., Bacterial flagellin stimulates TLR5-dependent defense against vancomycin-resistant *Enterococcus* infection. 2010. Journal of Infectious Disease 201(4): 534-543.
38. Artis D. Epithelial-cell recognition of commensal bacteria and maintenance of immune homeostasis in the gut. 2008. Nature Reviews Immunology 8:411-420.
39. Vaishnava S et al., Paneth cells directly sense gut commensals and maintain homeostasis at the intestinal host-microbial interface. 2008. PNAS.
40. Macpherson A J et al., Interactions between commensal intestinal bacteria and the immune system. 2004. Nature Reviews Immunology 4: 478-485.
41. Rakoff-Nahoum S et al., Recognition of commensal microflora by toll-like receptors is required for intestinal homeostasis. 2004. Cell 118:229-241.
42. Pamer E G. Immune responses to commensal and environmental microbes. 2007. Nature Immunology 8:1173-1178.
43. Cash H L et al., Symbiotic bacteria direct expression of an intestinal bactericidal lectin. 2006. Science 313: 1126-1130.
44. Ayabe T et al., Secretion of microbicidal alpha-defensins by intestinal Paneth cells in response to bacteria. 2000. Nature Immunology 1:113-118.
45. Vora P et al., Beta-defensin-2 expression is regulated by TLR signaling in intestinal epithelial cells. 2004. Journal of Immunology 173:5398-5405.
46. Kolls J K et al., Cytokine-mediated regulation of antimicrobial proteins. 2008. Nature Reviews Immunology 8: 829-835.
47. Brandl K et al., MyD88-mediated signals induce the bactericidal lectin RegIIIgamma and protect mice against intestinal *Listeria monocytogenes* infection. 2007. Journal of Experimental Medicine 204: 1891-1900.
48. Brandl K et al., Vancomycin-resistant enterococci exploit antibiotic-induced innate immune deficits 2008. Nature 455: 804-807.

INCORPORATION BY REFERENCE

All patents and publications referenced herein are hereby incorporated by reference in their entireties.

The publications discussed herein are provided solely for their disclosure prior to the filing date of the present application. Nothing herein is to be construed as an admission that the present invention is not entitled to antedate such publication by virtue of prior invention.

As used herein, all headings are simply for organization and are not intended to limit the disclosure in any manner. The content of any individual section may be equally applicable to all sections.

SEQUENCE LISTING (944 sequences)

SEQ ID NO: 1 - DNA, 1388 bp, Artificial Sequence
  Synthetic Polynucleotide
  misc_feature (7)..(7): n is a, c, g, or t
  misc_feature (407)..(408): n is a, c, g, or t
  misc_feature (728)..(728): n is a, c, g, or t
gaacggntgagtaacacgtgagtaacctgcccccttctttgggataacgcccggaaacgggtgctaatactggatattcactggtcttcgcatgggggttggtggaaagggttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgctcatggtcaagccgcaacaatggttgtggtgagggtagtgggtaaagaagcgccggctaactacgtnncagcagccgcggtaatacgtagggcgcgagcgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctggcccgttactgacgctgaggagcgaaagcgtggggagcgaacaggattagataccctggtagtccacgctgtaaacgttgggcactaggtgtggggnccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcggaccttgtacacaccgcccgtcacgtcacgaaagttggtaacacccgaagcccatggcctaaccggtttgccggggggagtggtcgaaggtgggaatggcgattgggacga

SEQ ID NO: 2 - DNA, 1481 bp, Artificial Sequence
  Synthetic Polynucleotide
agagtttgatcctggctcaggatgaacgctggcggcgtgcttaacacatgcaagtcgagcgagaagttttgaaaagattcttcggatgaaatttaaaatggaaagcggcggacgggtgagtaacgcgtaggcaaccatacaaagggatagcatttggaaacgaatattaataccttatgaaacttaactagtgcatgctaggtaggtcaaagatttatcggtatgggatgggcctgcgtctgactgcccttagctagttggtgaggtaacggctcaccaaggcgacgatcagtagccgacctgagagggtgaacggccacattggaactgagacacggtccaaactcctacgggaggcagcagtggggaatattgcacaatgggggaaaccctgatgcagcaacgccgcgtgaacgatgaaggcctttgggtcgtaaagttctgttctaggtgatgaaaactgacagtaacctaggagaaagccccggctaactccgtgccagcagccgcggtaatactggagggggcaagcgttatccggaattattgggcgtaaagggtacgtaggtggccttttaagcgtagggtataaggcaatggctcaaccattgttcgccctatgaactggaaggcttgagtgcaggagaggaaagcggaattcctagtgtagcggtggaatgcatagatattaggaggaacatcagcggcgaaggcggctttctggactgcaactgacactgaggtacgaaagcgtggggagcaaacaggattagataccctggtagtccacgccgtaaacgatgagcactaggtgtcggggtcgtaaggcttcggtgccgtagttaacgcattaagtgctccgcctggggagtacgcacgcaagtgtgaaactcaaaggaattgacggggacccgcacaagcagcggagcatgtggtttaattcgaagcaacgcgagaaccttaccaggacttgacatccttctgaccggtctttaataggacctttcttttgacagaagagacaggtggtgcatggttgtcgtcagctcgtgtcgtgagatgttgggttaagtcccgcaacgagcgcaacccttgtcattagttgccatcattaagttgggcactctagtgagactgccggggacaactcggaggaaggtggggatgacgtcaaatcatcatgccccttatgttctgggctacacacgtgctacaatggctggtacaaagagaagcaagaccgcaaggtggagcaaagctcaaaaaccagccccagttcggattgtaggctgaaactcgcctacatgaagtcggagttgctagtaatcgcagatcagaatgctgcggtgaatgcgttcccgggtcttgtacacaccgcccgtcacaccatggaagttgggggcgcccaaagttggcagataaatatgctacctaaggtgaaaccaatgactggggtgaagtcgtaacaaggtacccgtagg

SEQ ID NO: 3 - DNA, 1476 bp, Artificial Sequence
  Synthetic Polynucleotide
agagtttgatcctggctcaggatgaacgctggcggcgtgcctaacacatgcaagtcgagcgagaagtaaagaaatgaagcttcggtagattttcattatggaaagcggcggacgggtgagtaacgcgtaggcaacctgccctgtacagggggatagctacccgaaaaggtgattaataccccatgatgcaacaagagatacacatgtatcacttgtcaaagatttatcggtatgggatgggcctgcgtctgattagctagttggtaggttaacggcttaccaaggcaccgatcagtagccgacctgagagggtgatcggccacattggaactgagacacggtccaaactctacgggaggcagcagtggggaatattgcacaatggggctaaccctgatgcagcaacgccgcgtgaaggaagaaggcttcgggttgtaaacttctgtcctaggggaagaaacaaatgacattacccttggaggaagccccggctaactacgtgccagcagccgcggtaatacgtagggggcgaacgttatccggaattattgggcgtaaagagtgcgtaggtggcatcttaagcgcagggtttaaggcaatggctcaaccattgttcgccttgcgaactggggtgcttgagtgcaggaggggaaagtggaattcctagtgtagcggtgaaatgcgtagatattaggaggaacaccagtggcgaaggcgactttctggactgttactgacactgaggcacgaaagcgtggggagcaaacaggattagataccctggtagtccacgccgtaaacgatgagcactaggtgtcggggtcgcaagacttcggtgccgcagttaacgcattaaagtctccgcctggggagtacgcacgcaagtgtaaactcaaaggaattgacggggacccgcacaagcagcggagcatgtggtttaattcgaagcaatgcgaagaaccttaccaggacttgacatcctcttgacagatccttaatcggattcttcttcggacaagagagacaggtggtgcatggttgtcgtcagctcgtgtcgtgagatgttgggttaagtcccgcaacgagcgcaacccttgtcgttagttgccatcattcagttgtggcactctagcgagactgccgaggacaactcggaggaaggtggggatgacgtcaaatcatcatgccccttatgttttgggctacacacgtgctacaatggtcggtacaatgagatgcaatactgcgaagtggagcgaaacaccaaaaccgatcccagttcggattgtaggctgcaactcgcctacatgaagtcggagttgctagtaatcgcagatcagaatgctgcggtgaatgcgttcccgggtcttgtacacaccgcccgtcacaccatggaagttgggggtgcccaaagtcggttaattaatctatcgcctaaggcaaaaccaatgactggggtgaagtggtaacaaggta

SEQ ID NO: 4 - DNA, 1457 bp, Artificial Sequence
  Synthetic Polynucleotide
agagtttgatccttggtcaggacgaaccgctggcggcgtgcctaacacatgcaagtcgaacggggttacattgaggaagttttcggatggaattgatgtaatctagtggcgaacgggtgagtaacgcgtgagtaacctgcctcgaagagggggataacaacgagaaatcgttgctaataccgcataagaccacagggccgcatggtccaggggtcaaaactccggtgctttgagatggactcgcgtcccattaggtagttggtgaggtaacggcccaccaagccgacgatgggtagccgagctgagaggctgatcggccacactgggactgagacacggcccagactcctacgggaggcagcagtggggaatattgggcaatgggcgcaagcctgacccagcaacgccgcgtgaaggatgaaggttttcggattgtaaacttctgtcctcagggacgaaaggaatgacggtacctgaggaggaagccccggctaactacgtgccagcagccgcggtaatacgtagggggcgagcgttgtccggaattacttgggcgtaaagggagcgtaggcggccaattaagtcagatgtgaaattcccgggcttaacctgggcagtgcatctgaaactggatggcttgagtgcgggagaggaaagtggaattcctagtgtagcggtgaaatgcgtagatattaggaggaacaccagtggcgaaggcgactttctggaccgtaactgacgctgaggctcgaaagcgtggggagcaaacaggattagataccctggtagtccacgccgtaaacgatgaatactaggtgtagggggtatcaactccctctgtgccgcagcaaacgcaataagtattccgcctggggagtacggccgcaaggttgaaactcaaaggaattgacgggggcccgcacaagcagcggagcatgtggtttaattcgaagcaacgcgaagaaccttaccaaggcttgacatccacttaaagccatagaaatatggtgtctcttcggaggaagtgagacaggtggtgcatggttgtcgtcagctcgtgtcgtgagatgttgggttaagtcccgcaacgagcgcaacccctattgccagttaccagcgattcggtcgggaactctggtgagaccgccggggacaactcggaggaaggtggggacgacgtcaaatcatcatgccccttatgtcttgggctacacacgtgctacaatggcagttacagagggaagcgaagccgcaaggcggagcaaatcccaaaaaagctgtcccagttcggattgtgggctgcaacccgcccacatgaagtcggagttgctagtaatcgcggatcagcatgccgcggtgaatacgttcccgggccttgtacacaccgcccgtcacaccatgggagttgggagcgcccgaagtcagtatcctaaccgcaaggggggagctgccgaagg

SEQ ID NO: 5 - DNA, 1460 bp, Artificial Sequence
  Synthetic Polynucleotide
  misc_feature (110)..(111): n is a, c, g, or t
  misc_feature (303)..(303): n is a, c, g, or t
atgcaagtcgaacgagacgattgaaagcttgcttttgaaagtcgagtggcaaacgggtgagtaacgcgtaggcaacctgccttcgagatggggacaacagtccgaaaggnnctaataccgaatgttgtgacggaaccacatggattcgtcatgaaagatggcctctatttataagctatcgctcgaagatgggcctgcgtctgattagctggttggtggggcaacggcctaccaaggcgacgatcagtagccggtctgagaggatgaacggccacattggaactgagacacggtccagactcntacgggaggcagcagtggggaatcttccgcaatgggcgaaagcctgacggagcaacgccgcgtgagtgaagaaggccttcgggtcgtaaagctctgttgtcggggacgaatgtagttaccatcaacaaccgtaactaatgacggtacctgacgaggaagccacggctaactacgtgccagcagccgcggtaatacgtaggtggcgagcgttgtccggaattattgggcgtaaagggagcgcaggcgggaggccaagtccatcctaaaagtgcggggctcaaccccgtgaggggatggaaactggtcttcttgagtgcaggagaggaaagcggaattcctagtgtagcggtgaaatgcgtagatattaggaggaacaccagtggcgaaggcggctttctggactgtaactgacgctgaggctcgaaagctaggggagcgaacgggattagataccccggtagtcctggccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacatcgagtgaaagggcaagagattgtcccctctccttcgggagacacgaagacaggtggtgcatggctgtcgtcagctcgtgtcgtgagatgttgggttaagtcccgcaacgagcgcaacccctattccttgttgccagcacgcgaaggtgggaactcaaggaagactgccgcggacaacgcggaggaaggcggggatgacgtcaagtcatcatgccccttatgtcctgggctacacacgtactacaatgggacggacagagagcagcgaaggagcgatcccaagcgaaccccataaaccgtctcccagttcggattgcaggctgcaacccgcctgcatgaagtcggaatcgctagtaatcgcaggtcagcatactgcggtgaatacgttcccgggccttgtacacaccgcccgtcacaccacggaagtcattcacacccgaagccggtggcctaacttaggagggagccgtctaaggtgggggcgatgactggggtgaagtcg

SEQ ID NO: 6 - DNA, 1426 bp, Artificial Sequence
  Synthetic Polynucleotide
agagtttgatcatggctcaggacgaacgctggcggcgcgcttaacacatgcaagtcgaacggagcgaacgggatgaagccttcgggcggaattccgtgagcttagtggcgaacgggtgagtaacgcgtgagcaactggtcccaaagagggggacaactttgagaaatcaaggctaataccgcgtaagaccacactgccgcatggcagaggggtcaaaggagaaatccgctttggggagggctcgcgtctgattaggtagttggtgaggtaacggctcaccaagccgacgatcagtagccgtgctgagaggcaggccggccacactggaactgagacacggtccagactcctacgggaggcagcagtggggaatcttgggcaatgggggaaaccctgacccagcgacgccgcgtgagggaagaaggtcttcggattgtaaacctttgtgacaggggacgaaggaagtgacggtaccctgtgaggaagccccggctaactacgtgccagcagccgcggtaatacgtagggggcgagcgttgtccggaattactgggcgtaaagggcgcgtaggcggttgaataagtctgttgtgaaattccaaggcttaactttggcagtgcaatggaaactgttcgacttgagtacggcagaggcaagtggaattcccagtgtagcggtgaaatgcacagagattgggaggaacaccagtggcgaaggcgacttgctgggccgaaactgacgctgaggcgcgaaagcgtggggagcaaacaggattagataccctggtagtccacgccgtaaacgatgaatactaggtgtaggtggtatagaagccatctgtgccgcagcgaacgcattaagtattccgcctggggagtacggccgcaaggttgaaactcaaaggaattgacgggggcccgcacaagcagcggagcatgtggtttaattcgaagcaacgcgaagaaccttaccaggtcttgacatccaactaaaggcatagagatatgctgttccttcgggagagattgagacaggtggtgcatggttgtcgtcagctcgtgtcgtgagatgttgggttaagtcccgcaacgagcgcaacccctacaaacagttgccagtgcgtaaaggcaggcactctgttaggactgccgtggacaacacggaggaaggtggggacgacgtcaaatcatcatgccccttatgacctgggctacacacgtgctacaatggctgttacaaagagaagcgaagccgtaaggcggagcggatctcaaaaaggcagtcccagttcggattgtgggctgcaacccgcccacatgaagttggagttgctagtaatcgcgaatcagaatgtcgcggtgaatgcgttcccgggccttgtacacaccgcccgtcacaccatgggagttgggggcgcccgaagccg

SEQ ID NO: 7 - DNA, 1410 bp, Artificial Sequence
  Synthetic Polynucleotide
  misc_feature (12)..(12): n is a, c, g, or t
agagtttgatcntggctcaggacgaacgctggcggcgtgctttaacacatgcaagtcgaacgggcttattttgggagtaatcccggggtaagctagtggcggacgggtgcgtaacgcgtgagcaatctgtcctcaagagggggataacaactggaaacagttgctaataccgcatgagaccacaagttcacatggacaaggggttaaaggagaaatccgcttgagggtgagctcgcgtcccattagatagttggtgaggtaacggcccaccaagtcgacgatgggtagccgatctgagaggatgaccggccacattggaactgagaaacggtccagactcctacgggaggcagcagtggggaatattgggcaatgggcgcaagcctgacccagcaacgccgcgtgagggaagaaggttttcggatcgtaaacctctgttgcaggggacgagcagtagacggtaccctgcgaggaagctccggctaactacgtgccagcagccgcggtaatacgtagggagcaagcgttgtccggaatgactgggcgtaaagggcgcgtaggtggttttgtaagtctggagtgaaacccccgttttcaaggcggggcctgctttggagactgtaggacttgagtgatggagaggatagcggaattcccggtgtagcggtgaaatgcgtagagatcgggaggaacaccagtggcgaaggcggctatctggacatagactgacactgaggcgcgaaagcgtggggagcaaacaggattagataccctggtagtccacgctgtaaacgatggatgctaggtgtaggaggtatcgaccccttctgtgccggagtaaacacaataagcatcccgcctggggagtacggccgcaaggttgaaactcaaaggaattgacgggggcccgcacaagcagcggagcatgtggtttaattcgacgcaacgcgaagaaccttaccaggtcttgacatccagttaaagcatatgaaagtatgtgtctcttcggaggaactgagacaggtggtgcatggttgtcgtcagctcgtgtcgtgagatgttgggttaagtcccgcaacgagcgcaacccttgcgattggttgctaacaggtaaagctgagaactccaataggactgccggggacaactcggaggaaggtggggacgacgtcaaatcatcatgccccttatgacctgggctacacacgtgctacaatggccactacaaagaggagcgaatccgtaaggaggagcagatctgagaaaagtggtcccagttcagattgtgggctgcaacccgcccacatgaagtcggagttgctagtaatcgcggatcagcatgccgcggtgaatacgttcccgggccttgtacacaccgcccgtcacaccatgggagttgggagcacccga

SEQ ID NO: 8 - DNA, 1438 bp, Artificial Sequence
  Synthetic Polynucleotide
tcaggatgaacgctggcggcgtgcctaacacatgcaagtcgagcgagaagccttaagaagaagcttcggcggaattttaaggcggaaagcggcggacgggtgagtaacgcgtaggcaacctgcccctagcagagggatagcctcgggaaaccgtgattaaaacctcataaagccgagacagcacatgctgaagcggccaaagatttatcggcaagggatgggcctgcgtctgattagctagtaggtggggtaacggcccacctaggcgacgatcagtagccgacctgagagggtgatcggccacattggaactgagacacggtccaaactcctacgggaggcagcagtggggaatattgcacaatgggggaaaccctgatgcagcaacgccgcgtgaaggaagaaggcctttgggtcgtaaacttctgtccttggggaagataatgacggtacccttggaggaagccccggctaactacgtgccagcagccgcggtaatacgtagggggcaagcgttatccggaattattgggcgtaaagggtacgtaggcggtttcttaagcgcagggtttaaggcaatggctcaaccattgttcgccctgtgaactgggagacttgagtgcaggagaggaaagcggaattcctagtgtagcggtgaaatgcgtagatattaggaggaacaccagtggcgaaggcggctttctggactgtaactgacgctgaggtacgaaagtgtggggagcaaacaggattagataccctggtagtccacaccgtaaacgatgagcactaggtgtcgggaccgcaaggtttcggtgccgcagttaacgcattaagtgctccgcctggggagtacgtacgcaagtatgaaactcaaaggaattgacggggacccgcacaagcagcggagcatgtggtttaattcgaagcaacgcgaagaaccttaccaggacttgacatctccctgacagtcccttaaccgggatcttctacggacagggaagacaggtggtgcatggttgtcgtcagctcgtgtcgtgagatgttgggttaagtcccgcaacgagcgcaacccttgtcattagttgccatcattaagttgggcaactctagtgagactgccggggacaactcggaggaaggtggggatgacgtcaaatcatcatgccccttatgttctgggctacacacgtgctacaatggctggtacaaaaggcagcgaaaccgtgaggtggagcgaatcccaaaaaccagtcccagttcggattgcaggctgcaactcgcctgcatgaagttggagttgctagtaatcgcagatcagaatgctgcggtgaatgcgttcccgggtcttgtacacaccgcccgtcacaccatggaagtcgggggcgcccgaagtcggttagcaaatagactgcctaaggcgaaatcgatgactggg

SEQ ID NO: 9 - DNA, 1488 bp, Artificial Sequence
  Synthetic Polynucleotide
ttgatcctggctcagattgaacgctggcggcatgccttacacatgcaagtcgaacggcagcatggagagcttgctctctgatggcgagtggcgaacgggtgagtaatacatcggaacgtgtccgtttgtgggggacaaccgtccgaaaggatggctaataccgcatgagacctgagggtgaaagccggggaccgcaaggcccggcgcagacggagcggccgatgattgattagctagttggggaggtaaaggctcaccaaggcgacgatcaatagctggtctgagaggacgaccagccacactggaactgagacacggtccagactcctacgggaggcagcagtggggaattttggacaatgggggcaaccctgatccagccatgccgcgtgcgggaagaaggccttcgggttgtaaaccgcttttgtcagggacgaaaagctccggagtaatatgccggagtgctgacggtacctgaagaataagcaccggctaactacgtgccagcggccgcggtaatacgtagggtgcgagcgttaatcggaattactgggcgtaaagcgtgcgcaggcggttgggtaagacagatgtgaaatccccaggcttaacctgggaactgcatttgtgactgtccgactggagtacgtcagaggggggtggaattccacgtgtagcagtgaaatgcgtagatatgtggatgaacaccgatggcgaaggcagccccctgggacgcaactgacgctcatgcacgaaagcgtggggagcaaacaggattagataccctggtagtccacgccctaaacgatgtctgctggttgttgggaatttaattctcagtaacgaagccaacgcgtgaagcagaccgcctggggagtacgggcgcaagattaaaactcaaaggaattgacggggacccgcacaagcgggggatgatgtggattaattcgatgcaacgcgaaaaaccttacccagccttgacatgtcaggaatgcctcggagatgaggcggtgcccgcaagggaacctgagcacaggtgctgcatggctgtcgtcagctcgtgtcgtgagatgttgggttaagtcccgcaacgagcgcaacccttgtcatcagttgctacgaaagggcactctgatgagactgccggtgacaaaccggaggaaggtggggatgacgtcaagtcctcatggcccttatggctggggcctcacacgtcatacaatggtcggaacagagggtagcgaagccgcgaggtgaagccaatcccagaaaaccgatcgtagtccggattgcagctctgcaactcgactgcatgaagtcggaatcgctagtaatcgcggatcagcatgccgcggtgaatacgttcccgggtcttgtacacaccgcccgtcacaccatgggagtggggttcaccagaagacgtttgcccaaccgcaaggaaggcggcgcccacggtgggtttcatgactggggtgaagtcgtaacaaggta

SEQ ID NO: 10 - DNA, 1453 bp, Artificial Sequence
  Synthetic Polynucleotide
agagtttgatcatggctcaggatgaacgctggcggcgtgcttaacacatgcaagtcgaacgaagcatttaagacggatttcttcggaatgaagacttttatgactgagtggcggacgggtgagtaacgcgtgggcaacctgcctcacacagggggatagcagctggaaacggctggtaataccgcataagcgcacagtaccgcatggtacagtgtgaaaaactccggtggtgtgagatggacccgcgtctgattaggtagttggtgaggcaacggctcaccaagccgacgatcagtagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcagcagggaagacagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttctcttcggagcagtggagacaggtggtgcatggttgtcgtcagctcgtgtcgtgagatgttgggttaagtcccgcaacgagcgcaacccctgtccttagtagccagcatttaaggtgggcactctagggagactgccggggataacccggaggaaggcggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcggtgacctaacgaaaggaggagccgccgaag

SEQ ID NO: 11 - DNA, 1492 bp, Artificial Sequence
  Synthetic Polynucleotide
agagtttgattatggctcaggatgaacgctggckgcgtgcttaacacatgcaagtcgaacgaagcactttatttgattttcttcgggaatgattatttagtgactgadtggcggacgggtgartaacgcgtgggtaacctgcctcatacagggggatagcagttggaaacgactggtaataccgcataagcgcacaggaccgcatggtcgggtgtgaaaaactccggtggtatgagatggacccgcgtctgattagctagttggtggggtaacggcctaccaaggcgacgatcagtagccggcctgagagggtgaacggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatacaagtcagaagtgaaagcccggggctcaaccccsggactgcttttgaaactgtaaggcttgagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccaaaagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgacctttccttcgggacaagagagacaggtggtgcatggttgtcgtcagctcgtgtcgtgagatgttgggttaagtcccgcaacgagcgcaacccctattactagtagccagcatttagttgggcactctagtgagactgccagggataacctggaggaaggtggggatgacgtcaaatcatcatgccccttatgacttgggctacacacgtgctacaatggcgtaaacaaagagaagcaaaaccgtgaggtcaagcaaatcccaaaaataacgtctcagttcggactgtagtctgcaacccgactacacgaagctggaatcgctagtaatcgcagatcagcatgctgcggtgaatacgttcccgggtcttgtacacaccgcccgtcacaccatgggagttggtaatgcccgaaatcagtgatccaaaaacggaagctgctgaaggcaggactaataactggggtgaagtcgtaacaaggtaaccgta

SEQ ID NO: 12 - DNA, 1546 bp, Artificial Sequence
  Synthetic Polynucleotide
gagtttgattctggctcaggacgaacgctggcggcgtgcttaacacatgcaagtcgaacgggcccgcaccttttttgggggcgggttgagtggcgaacgggtgagtatcacgtgagtaacctgccctcctctcctggataaccgcttgaaagggcggctaatacggggtggtccggttggtccgcatgggccggtcgggatagtttcatcttcgggtgtttcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctgtttccggtggtgaaggccccgcccctggtggtggggttgacggtagccgggtatgaagcgccggctaactacgtgccagcagccgcggtaatacgtagggcgcgagcgttgtccggaattattgggcgtaaagggcttgtaggcggccggccgcgtccgtcgtgaaatcctccggctcaaccgggggcttgcggtgggtacgggtcggctggagtgcggcaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccggtttgccggggggagtggtcgaaggtgggattggcgattgggacgaagtcgtaacaaggtagccgtaccggaaggtgcggctggaacacctcctt

SEQ ID NO: 13 - DNA, 1532 bp, Artificial Sequence
  Synthetic Polynucleotide
gagtttgattctggctcaggacgaacgctggcggcgtgcttaacacatgcaagtcgaacgatgaagcgctgtctttttggcggtgtggattagtggcgaacgggtgagtaatacgcgggcaacctgcccctctgcttcgggataagctttggaaacggggtctaataccggatgtgcctgtctggtcgcatggctgggcggggaaagatgtttttcggcgggggatgggctcgcggcctatcagcttgttggtggggtgacggcctaccaaggcgtcgacgggtagccggcctgagagggtggtcggccacactgggactgagatacggcccagactcctacgggaggcagcagtgggggatattgcacaatgggcgcaagcctgatgcagcgacgccgcgtgggggatggaggctttcgggttgtaaacccctttcggcgcgggacaaggctccgtttggcggggttgagggtacgcgtcaaagaagcgccggctaactacgtgccagcagccgcggtaatacgtagggcgcgagcgttgtccggaattattgggcgtaaagggctcgtaggcggcttgtcgcgtctgctgtgaaaacgcggggctcaactccgcgcgtgcagtgggtacgggcaggctggagtgcggcaggggtggctggaattcctggtgtagcggtggaatgcgcagatatcaggaagaacaccgatggcgaaggcaggccactgggccgtcactgacgctggggagcgaaagcgtggggagcgaacaggattagataccctggtagtccacgccgtaaacgttgggcactaggtgtggggggccttttccgggtcttccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatgtgccggtcggctccggagacgggagcgtcccctttttgtgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaaggtgcggctggaacacctcctt

SEQ ID NO: 14 - DNA, 1544 bp, Artificial Sequence
  Synthetic Polynucleotide
gagtttgatcctggctcaggacgaacgctggcggcgtgcttaacacatgcaagtcgaacggtgaagggatcagcttgctggttctggatgagtggcgaacgggtgagtaacacgtgagtaacctgcccccttcttctggataaccgcatgaaagtgtggctaatacgggatattctgggtctgtcgcatggcgggtctgggaaagatgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcgtgcggtgggtacgggccggcttgagtgcggtaggggaggctggaattcctggtgtagcggtggaatgcgcagatatcaggaggaacaccggtggcgaaggcgggtctctgggccgtgtactgacgctgagagcgaaagcgtggggagcgaacaggattagataccctggtagtccatgctgtaaacgttgggcactaggtgtggggggtctttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggtggttcccggagacgggagcgtcccctttttgtgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccctgtacacaccgcccgtcacgtcatgaaagtcggcaacacccgaagcccgtggccttatggggagcggtcgaaggtggggctggtgattgggacgaagtcgtaacaaggtagccgtaccggaaggtgcggttggatcacctcctt

SEQ ID NO: 15 - DNA, 1504 bp, Artificial Sequence
  Synthetic Polynucleotide
gagtttgatcctggctcaggacgaacgctggcggcgtgcctaacacatgcaagtcgaacggacgagtcccttcgggggcgagttagtggcgaacgggtgagtaacgcgtgaacaacctgccttcctgagggggataacacctggaaacagatgctaataccgcataagaccacagtgccgcatgacacaggggtcaaaggagcaatccgcaggaagaggggttcgcgtcccattagctggttggcggggcaacggcccaccaaggcgacgatgggtagccgagctgagaggctgatcggccacactggaactgagacacggtccagactcctacgggaggcagcagtggggaatattgggcaatgggcgcaagcctgacccagcaacgccgcgtgagggatgaaggccttcgggttgtaaacctctgtccttggtgacgaaacaaatgacggtagccaaggaggaagccccggctaactacgtgccagcagccgcggtaatacgtaggggscgagcgttgtccggaattactgggtgtaaagggagcgcaggcggagaagcaagtcagtggtgaaaacgatgggcttaactcatcgactgccattgaaactgtttcccttgagtgaagtagaggcaggcggaattccgagtgtagcggtgaaatgcgtagatattcggaggaacaccagtggcgaaggcggcctgctgggctttaactgacgctgaggctcgaaagtgtggggagcaaacaggattagataccctggtagtccacactgtaaacgatgattgctaggtgtggggggtctgaccccttccgtgccggagttaacgcaataagcaatccacctggggagtacggccgcaaggttgaaactcaaaggaattgacgggggcccgcacaagcagtggattatgtggtttaattcgacgcaacgcgaagaaccttaccaggtcttgacatccaacgaatccttaagagattagggagtgcctttcggggaacgttgagacaggtggtgcatggttgtcgtcagctcgtgtcgtgagatgttgggttaagtcccgcaacgagcgcaacccctgccattagttgctacgcaagagcactctaatgggaccgctaccgacaaggtggaggaaggtggggacgacgtcaaatcatcatgccccttatgacctgggctacacacgtaatacaatggccgttaacaacgggaggcaaaaccgcgaggtggagcaaaaccctaaaaacggtcccagttcggatcgcaggctgcaacccgcctgcgtgaagttggaattgctagtaatcgcggatcagcatgccgcggtgaatacgttcccgggccttgtacacaccgcccgtcacaccatgggagtttgtaacacccgaagtcagtagtctaaccgcaagggggacgctgccgaaggtgggataagcgactggggtgaagtcgtaacaaggtagccgtatcggaaggtgcggctggatcacctcctt

SEQ ID NO: 16 - DNA, 1363 bp, Artificial Sequence
  Synthetic Polynucleotide
attgaacgctggcggaacgctttacacatgcaagtcgaacggtaacgcggagggaagcttgcttctctccggcgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacaccttttaataaagggtgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccctaaacgatgttaactagttgttgggaagtaatattctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccttgacatgtcaggaagctcttgtaatgagagcgtgcccgcaagggagcctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagcgaagtcgcgaggtggagcgaaccccaaaaacccgatctcagttcggatcgcaggctgcaacccgcctgcgtgaagtcggaatcgctagtaatcgcaggtcagcatactgcggtgaatacgttcccgggcct

SEQ ID NO: 17 - DNA, 1387 bp, Artificial Sequence
  Synthetic Polynucleotide
attgaacgctggcggcgtgcttaacacatgcaagtcgaacgagaaagttccttcgggaatgagtagagtggcgcacgggtgagtaacgcgtggataatctaccggggagtggggaataacagttggaaacggctgctaataccgcatacgctgcatattatatcatatgcaggaaagggggcctctgcatatgcttccgcttttcgatgagtccgcgtcccattagcttgttggcggggtaacggcccaccaaggcgacgatgggtagctggtctgagaggatgaccagccacactgggactggaacacggcccagactcctacgggaggcagcagtggggaatattgcgcaatgggcgaaagcctgacgcagcgacgccgcgtgagggatgaaggttttcggatcgtaaacctctgtcagaagggaagaagttgcatggggccaatcacctgtgcattgacggtaccttcaaaggaagcaccggctaactccgtgccagcagccgcggtaatacggagggtgcgagcgttaatcggaattactgggcgtaaagcgcacgtaggctgttatgtaagtcaagggtgaaatcccacggctcaaccgtggaactgcctttgaaactggcaaactggagtatgtgagagggcggcggaattcctggtgtaggagtgaaatccgtagatatcaggaggaacatcagtggcgaaggcggccgcctggcacaaaactgacgctgaggtgcgaaagcgtgggtagcaaacaggattagataccctggtagtccacgctgtaaacgatggatactgggtgttgggttttattgactcggcgccgtagctaacgcgttaagtatcccgcctggggagtacggtcgcaaggctgaaactcaaagaaattgacgggggcccgcacaagcggtggagtatgtggtttaattcgatgcaacgcgaagaaccttacccaggcttgacatccagggaacccatgtgaaagcgtggggtactcttcggaggaccctgagacaggtgctgcatggctgtcgtcagctcgtgccgtgaggtgttgggttaagtcccgcaacgagcgcaacccctgttcttagttgccatcaggtaaagctgggcactctagggagaccgccccggttaacggggaggaaggtggggacgacgtcaagtcatcatggcccttacgcctggggctacacacgtactacaatggcgcatacaaagggaagcgaagccgtgaggcgaagccaatctcaaaaaatgcgtcccagttcggattggagtctgcaactcgactccatgaagtcggaatcgctagtaattccggatcagcatgccggggtgaatgcgttcccgggccttgtacacaccgcccgtc

SEQ ID NO: 18 - DNA, 1350 bp, Artificial Sequence
  Synthetic Polynucleotide
acgaacgctggcggcgtgcctaaacacatgcaagtcgaagcggagaataaagaatttcggtttttatcttagcggcgcacgggtcgagtaacacgtgaaataaacctcgaacccaaagagggggataacacctcggaaaacaggtcgctaataccgcataagaaccacaatgtcgcatgacgaaggggtcaaagaaaatcgctttgggaggggttcgcgtcccattaggtagtaggcggggtaacggcccacctagccgactatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcagaagacgaaggaagtgacggtattctgtgaggaagccccggctaactacgtgccagcagccgcggtaatacgtagggggcgagcgttgtccggaattactgggcgtaaagggagcgtaggcggtctgataagttggatgtgaaatacccgggcttaacttggggggtgcatccaatactgttggactagagtacaggagaggaaagcggaattcctagtgtagcggtgaaatgcatagatattaggtggaacatcggtggcgaaggcggctttctggactgcaactgacgctgaggctcgaaagcgtggggagcaaacaggattagataccctggtagtccacgctgtaaacgatgaatactaggtgtagggggtataaactccctctgtgccgcagcaaacgcaataagtattccgcctggggagtacggccgcaaggttgaaactcaaaggaattgacgggggcccgcacaagcagcggagcatgtggtttaattcgacgcaacgcgaagaaccttaccaaggcttgacatccacttaaagttatggaaacataatgtcccttcgggggaagtgagacaggtggtgcatggttgtcgtcagctcgtgtcgtgagatgttgggttaagtcccgcaacgagcgcaacccctgttgccagttgccagcaagtaaagttggggactctggtgagactgccggggacaactcggaggaaggtggggatgacgtcaaatcatcatgccccttatgtcttgggctacacacgtgctacaatggctgtaacaaagggaagcgaccttgtaagaggaagcggatctcagaaaagcagtcccagttcggattgtgggctgcaacccgcccacatgaagtcggagttgctagtaatcgcggatcagcatgccgcggtgaatacgttcccgggcct

SEQ ID NO: 19 - DNA, 1493 bp, Artificial Sequence
  Synthetic Polynucleotide
gagtttgatcctggctcaggacgaacgctggcggcatgcctaacacatgcaagtcgaacggagattacttcggtaatcttagtggcgaacgggtgagtaacgcgtaggcaacctgcccttcagatggggacaacatcccgaaaggggtgctaataccgaatgtgatcacaacctcgcatgaggatgtgatgaaagatggcctctatttataagctatcgctgaaggatgggcctgcgtctgattagctagttggtaaggtaacggcttaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaagggattcgtcccgtaaagctctgttgtctatgacgaatgtgcatgttgtgaacaatgacgtgtaatgacggtagtagacgaggaagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgaatgaccatcttagagataagatttcttcttcggaagcatgaaaacaggtggtgcatggctgtcgtcagctcgtgtcgtgagatgttgggttaagtcccgcaacgagcgcaacccctatcctatgttaccagcacgtaaaggtggggactcataggagactgccaaggacaacttggaggaaggcggggatgacgtcaagtcatcatgccccttatgtcttgggctacacacgtactacaatggtcgacaacagagggaagcgaagccgcgaggcagagcaaaccccagaaactcgatctcagttcggattgcaggctgcaactcgcctgcatgaagtcggaatcgctagtaatcgcaggtcagcatactgcggtgaatacgttcccgggccttgtacacaccgcccgtcacaccacgaaagttggtaacacccgaagccggtggggtaaccgaaaggagccagccgtctaaggtggggccgatgattggggtg

SEQ ID NO: 20 - DNA, 1343 bp, Artificial Sequence
  Synthetic Polynucleotide
gacgaacgctggcggcgtgcttaatacatgcaagtcgaacgagaggaaggaaagcttgcttttctgaatctagtggcgaacgggtgagtaacgcgtgaataacctgactcaaagagggggataacaacgggaaactgttgctaataccgcataggtagcagacaagcatttgactgctattaaagtggccttggctttgagaggggttcgcgtcccattaggtagttggaggggtaacggcccaccaagccaacgatgggtagccgagctgagaggctgatcggccacactggaactgagacacggtccagactcctacgggaggcagcagtagggaatattgggcaatgggcgcaagcctgacccagcaacgccgcgtgagggaagaaggttttcggattgtaaacctctgtcctatgtgacgaaggaagtgacggtagcataggaggaagccccggctaactacgtgccagcagccgcggtaatacgtagggggcgagcgttgtccggaattactgggcgtaaagggtgcgtaggcggtttggtaagttggatgtgaaatacccgggcttaacttgggggctgcatccaatactgtcggacttgagtacaggagaggaaagcggaattcctagtgtagcggtgaaatgcgtagatattaggaggaacaccggtggcgaaggcggctttctggactgtaactgacgctgaggcacgaaagcgtggggagcaaacaggattagataccctggtagtccacgccgtaaacgatgaatactaggtgtagggggtatagactccctctgtgccgcagcaaacgcaataagtattccgcctggggagtacggccgcaaggttgaaactcaaaggaattgacgggggcccgcacaagcagcggagcatgtggtttaattcgacgcaacgcgaaaaaccttaccaagacttgacatcctactaaactcatggaaacatgaggtgacttcggtcgagtagagacaggtggtgcatggttgtcgtcagctcgtgtcgtgagatgttgggttaagtcccgcaacgagcgcaacccctgttgccggttaccagcgagtaaagtcggggactccggtgagactgccgaggacaactcggaggaaggtggggacgacgtcaaatcatcatgccccttacgtcttgggctacacacgtgctacaatggctgtaacaaagggaagcgacagcgtaagctgaagcggatctcgaaaaggcagtcccagttcggattgtgggctgcaacccgcccacatgaagtcggagttgctagtaatcgcggatcagcatgccgcggtgaatacgttcccgggcct

SEQ ID NO: 21 - DNA, 1438 bp, Artificial Sequence
  Synthetic Polynucleotide
gatgaacgctggcggcgtgcctaacacatgcaagtcgagcgagaagctgatgattgacacttcggttgagagaatcagtggaaagcggcggacgggagagtaacgcgtaggcaacctgccctttgcagagggatagcctcgggaaaccgggattaaaacctcatgatgctgtatgtccgcatgggcagacggtcaaagatttatcggcagaggatgggcctgcgtctgattagttagttggtggggtaacggcctaccaaggcaacgatcagtagccgacctgagagggtgatcggccacattggaactgagacacggtccaaactcctacgggaggcagcagtggggaatattgcacaatgggggaaaccctgatgcagcaacgccgcgtgagcgaagaaggcctttgggtcgtaaagctctgtccttggggaagaaaaaatgacggtacccaaggaggaagccccggctaactacgtgccagcagccgcggtaatacgtagggggcaagcgttatccggaattattgggcgtaaagagtatgtaggtggtttcttaagcgcagggtataaggcaatggcttaaccattgttcgccccgtgaactgagagacttgagtgctggagaggaaagcggaattcctagtgtagcggtgaaatgcgtagatattaggaggaacaccagtggcgaaggcggctttctggacagtaactgacactgagatacgaaagcgtggggagcaaacaggattagataccctggtagtccacgccgtaaacgatgagcactaggtgtcgggctcgcaagagttcggtgccggagttaacgcattaagtgctccgcctggggagtacgcacgcaagtgtaaaactcaaaggaattgacggggacccgcacaagcagcggagcatgtggtttaattcgaagcaacgcgaagaaccttaccagggcttgacatccctccgaccggtccttaatcggacctttctacggacgggggagacaggtggtgcatggttgtcgtcagctcgtgtcgtgagatgttgggttaagtcccgcaacgagcgcaacccttgtcattagttgctaacagtaagatgagaactctaatgagactgccgtggataacacggaggaaggtggggatgacgtcaaatcatcatgccccttatgtcctgggctacacacgtgctacaatggtcggtacaaagagaagcgagaccgcaaggtggagcaaatctcaaaaaccgatcccagttcggattgcaggctgcaactcgcctgcatgaagtcggagttgctagtaatcgcagatcagaatgctgcggtgaatgcgttcccgggtcttgtacacaccgcccgtcacaccatggaagttgggggcgcccgaagtcggctagtaaataggctgcctaaggcgaaatcaatgactggggtg

SEQ ID NO: 22 - DNA, 1476 bp, Artificial Sequence
  Synthetic Polynucleotide
agagtttgatcctggctcaggatgaacgctggcggcgtgcctaacacatgcaagtcgagcgagaagctcgcaacggacgcttcggttgaagttgcgagtggaaagcggcggacgggtgagtaacgcgtaggcaacctgccctttgcagagggatagcctcgggaaaccgggattaaaacctcataacactttcctgagacatcttagggaggtcaaagatttatcggcaaaggatgggcctgcgtctgattagttagttggtgaggtaacggctcaccaaggcagcgatcagtagccgacctgagagggtgatcggccacattggaactgagacacggtccaaactcctacgggaggcagcagtgggggatattgcacaatgggggaaaccctgatgcagcaacgccgcgtgaaggaagaaggcctttgggtcgtaaacttctgttctgagggaagaataagacggtacctcaggagcaagtcccggctaactacgtgccagcagccgcggtaatacgtggggggcaagcgttatccggaatcattgggcgtaaagagtacgtaggtggttacctaagcacggggtataaggcaatagctcaactattgttcgccctgtgaactgggctacttgagtgcaggagagggaagcggaattcctagtgtagcggtgaaatgcgtagatattaggaggaacaccagtggcgaaggcggctttctggactgtaactgacactgaggtacgaaagcgtggggagcaaacaggattagataccctggtagtccacgccgtaaacgatgagcactaggtgtcggggtcgtaagacttcggtgccgcagttaacgcaataagtgctccgcctggggagtacgttcgcaagaatgaaactcaaaggaattgacggggacccgcacaagcagcggagcatgtggtttaattcgaagcaacgcgaagaaccttaccaaggcttgacatccctctgacgtacccgtaacggggtatttcttcggacagaggagacaggtggtgcatggttgtcgtcagctcgtgtcgtgagatgttgggttaagtcccgcaacgagcgcaacccttgtcattagttgccagcagtaagatgggcactctaatgagactgccggggacaactcggaggaaggtggggatgacgtcaaatcatcatgccccttatgtcttgggctacacacgtgctacaatggtcggaacagagagaaagcgagaccgcgaggtggagcgaaattcaaaaaccggccccagttcggattgcaggctgcaactcgcctgcatgaagtcggagttgctagtaatcgcagatcagaatgctgcggtgaatgcgttcccgggtcttgtacacaccgcccgtcacaccatggaagttgggggcgcccgaagttggctaagaaataggtcacctaaggcgaaatcaatgactggggtgaagtcgtaacaaggtaacc

SEQ ID NO: 23 - DNA, 1469 bp, Artificial Sequence
  Synthetic Polynucleotide
agagtttgatcctggctcaggatgaacgctggcggcgcgcctaacacatgcaagtcgaacggcacccctcttcggagggaagcgagtggcgaacggctgagtaacacgtggagaacctgccccctcctcggggatagccgcgggaaaccgcgggtaatacccgatgacccggtaccctcgcatgggggttccggcaaagctttcgcgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatgggggcaaccctgacgcagcgacgccgcgtgcgggatgaaggctctagggtcgtaaaccgctttcagcagggaagagacaagacggtacctgcagaagaagccccggctaactacgtgccagcagccgcggtaatacgtagggggcgagcgttatccggattcattgggcgtaaagcgcgcgtaggcggcccggtaggccggtgggtcgaagcggggggctcaaccccccgaagcccccggaacccccgtggcttgggtccggtaggggagggtggaacacccggtgtagcggtggaatgcgcagatatcgggtggaacaccggtggcgaaggcggccctctgggccgtgaccgacgctgaggcgcgaaagccgggggagcgaacaggattagataccctggtagtcccggccgtaaacgatggacgctaggtgtggggggacgatccctccgtgccgaagccaacgcattaagcgtcccgcctggggagtacggccgcagggctaaaactcaaaggaattgacgggggcccgcacaagcagcggagcatgtggcttaattcgaagcaacgcgaagaaccttaccagggcttgacatgagggtgaagcggcggagacgccgtggccgagaggagcccccacaggtggtgcatggctgtcgtcagctcgtgtcgtgagatgttgggttaagtcccgcaacgagcgcaacccccgccgcgtgttgccagcaggtcaagctgggcacccacgcgggaccgccggcgtcaagccggaggagggcggggacgacgtcaagtcatcatgccccttatgccctgggctgcacacgtgctacaatggccggtacagagggatgccaccccgcgagggggagcggatcccgtaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagccgccggcccaaccgtttggggggaggcgtcgaaggtgtggagggtgaggggggtgaagtcgtaacaaggtaacc

SEQ ID NO: 24 - DNA, 1478 bp, Artificial Sequence
  Synthetic Polynucleotide
agagtttgatcctggctcaggatgaacgctggcggcgtgcctaacacatgcaagtcgagcgagaagcctatgaaggatccttcgggtgacagattgggtggaaagcggcggacgggtgagtaacgcgtaggtaacctgccccatacagggggatagccactggaaacggtgattaataccccataatactcttcagtcacatgtctgaagggtcaaagatttatcggtatgggatggacctgcgtctgattagctagttggtggggtaaaggcctaccaaggcgacgatcagtagccgacctgagagggtgatcggccacattggaactgagacacggtccaaactcctacgggaggcagcagtggggaatattgcacaatgggcgcaagcctgatgcagcaacgccgcgtgattgatgaaggcctttgggtcgtaaagatctgttctgagggaagaaaaaaatgacggtacctcaggagaaagccccggctaactacgtgccagcagccgcggtaatacgtagggggcaagcgttgtccggaattattgggcgtaaagagtacgtaggcggtttgctaagcgcaaggtgaaaggcagtggcttaaccattgtaagccttgcgaactgacagacttgagtgcaggaggggaaagtggaattcctagtgtagcggtgaaatgcgtagatattaggaggaacaccagtggcgaaggcgactttctggactgtaactgacgctgaggtacgaaagcgtggggagcaaacaggattagataccctggtagtccacgccgtaaacgatgagcactaggtgtcggggccgcagggcttcggtgccgcagttaacgcaataagtgctccgcctggggagtacgcacgcaagtgtgaaactcaaaggaattgacggggacccgcacaagcagcggagcatgtggtttaattcgaagcaacgcgaagaaccttaccaggacttgacatccctctgacatatccttaaccggatactccttcgggcagaggtgacaggtggtgcatggttgtcgtcagctcgtgtcgtgagatgttgggttaagtcccgcaacgagcgcaacccttgttgctagttactaacattaagttgaggactctagcaagactgccggggacaactcggaggaaggtggggatgacgtcaaatcatcatgccccttatgttctgggctacacacgtgctacaatggccggtacagagagatgcgataccgtgaggtggagccaaacttcaaaaccggtctcagttcggactgtaggctgcaactcgcctacacgaagtcggagttgctagtaatcgcggatcagaatgccgcggtgagtgcgttcccgggtcttgtacacaccgcccgtcacaccatggaagttgggggcgcccaaagttggtcagaaaatagattacctaaggcgaaaccaatgactggggtgaagtcgtaacaaggtaacc

SEQ ID NO: 25 - DNA, 1458 bp, Artificial Sequence
  Synthetic Polynucleotide
attgaacgctggcggcatgctttacacatgcaagtcgaacggcagcatggagagcttgctctctgatggcgagtggcgaacgggtgagtaatacatcggaacgtgtccgtttgtgggggacaaccatccgaaaggatggctaataccgcataagacctgagggtgaaagccggggaccgcaaggcctggcgcgaacggagcggccgatgactgattagctggttggcggggtaaaggcccaccaaggcgacgatcagtagctggtctgagaggacgaccagccacactggaactgagacacggtccagactcctacgggaggcagcagtggggaattttggacaatgggggcaaccctgatccagccatgccgcgtgcgggaagaaggccttcgggttgtaaaccgcttttgtcagggacgaaaagcaagatgtgaacagcatcttgtgctgacggtacctgaagaataagcaccggctaactacgtgccagcagccgcggtaatacgtagggtgcaagcgttaatcggaattactgggcgtaaagcgtgcgcaggcggttgggtaagacagatgtgaaatccccgggcttaacctgggaactgcatttgtgactgtccgactagagtatgtcagaggggggtggaattccaagtgtagcagtgaaatgcgtagatatttggaagaacaccgatggcgaaggcagccccctggggcaaaactgacgctcatgcacgaaagcgtggggagcaaacaggattagataccctggtagtccacgccctaaacgatgtctactggttgttggagggtaaaaccttcagtaacgaagccaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcaggaacgcttcagagatgaggcggtgcccgcaagggaacctgagcacaggtgctgcatggctgtcgtcagctcgtgtcgtgagatgttgggttaagtcccgcaacgagcgcaacccttgtcactagttgctacgcaagagcactctagtgagactgccggtgacaaaccggaggaaggtggggatgacgtcaagtcctcatggcccttatggctagggcctcacacgtcatacaatggtcggaacagagggcagcgaagccgtgaggcggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaaggcgtttgcctaaccttcgggagggcggcgaccacggtgggtttcatgactggggtga

SEQ ID NO: 26 - DNA, 1476 bp, Artificial Sequence
  Synthetic Polynucleotide
agagtttgatcatggctcaggacaaacgctggcggcgtgcctaacacatgcaagtcgaacggagttacgggagcttgctcctgtaacttagtggcggacgggtgagtaacgcgtgaggaacctgcctttcagtgggggacaacagttggaaacgactgctaataccgcatgaaattcttcgggggcatccctgaggaatcaaagatttatcgctgaaagatggcctcgcgtctgattagctagttggtgaggtaacggcccaccaaggcgacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttcttttaccagggacgaagaacgtgacggtacctggagaaaaagctacggctaactacgtgccagcagccgcggtaatacgtaggtagcaagcgttgtccggaattattgggcgtaaagagcatgtaggcggcctattaagtcgggcgtgaaaatgcggggctcaaccccgtatggcgcccgatactggtgggcttgagtgcaggagaggaaaggggaattcccagtgtagcggtgaaatgcgtagatattgggaggaacaccagtggcgaaggcgcctttctggactgtgtctgacgctgagatgcgaaagccaggggagcgaacgggattagataccccggtagtcctggccgtaaacgatgggtactaggtgtaggaggtatcgaccccttccgtgccgcagctaacgcaataagtattccacctggggagtacgaccgcaaggttgaaactcaaaggaattgacgggggcccgcacaagcagtggattatgtggtttaattcgacgcaacgcgaagaaccttaccgggatttgacatcctactaacgaagtagagatacattaggcgcccttcggggaaagtagagacaggtggtgcatggttgtcgtcagctcgtgtcgtgagatgttgggttaagtcccgcaacgagcgcaacccctattgctagttgctacgcaagagcactctagcgagactgccgttgacaaaacggaggaaggtggggacgacgtcaaatcatcatgccccttatgtcccgggctacacacgtaatacaatggcggttaacaaagtgaagcaaaaccgcgaggtggagcaaatcacaaaaagccgtcccagttcggattgcaggctgcaactcgcctgcatgaagtcggaattgctagtaatcgcggatcagaatgccgcggtgaatacgttcccgggccttgtacacaccgcccgtcacaccatgagaatcgggaacacccgaagtccgtagtctaaccgcaaggagggcgcggccgaaggtgggcctggtaattggggtgaagtcgtaacaaggtagc

SEQ ID NO: 27 - DNA, 1431 bp, Artificial Sequence
  Synthetic Polynucleotide
tagtggcgaacgggtgagtaacgcgtaggcaacctgccctttagatggggacaacattccsaaaggggtgctaataccgaatgtgacggaccttccgcatggaaattccgtgaaagatggcctctacatgtaagctatcgctaaaggatgggccctgcgtctgattagttagttggtagggtaacggcttaccaagacgatgatcagtagccggtctgagaggatgaacggccacattgggactgagacacggcccagactcctacgggaggcagcagtggggaatcttccgcaatgggcgaaagcctgacggagcaatgccgcgtgagtgaagaaggaattcgttccgtaaagctcttttgtttatgacgaatgtgctgattgtgaataatgattagtaatgacggtagtaaacgaataagccacggctaactacgtgccagcagccgcggtaatacgtaggtggcgagcgttgtccggaattattgggcgtaaagagcatgtaggcggttttttaagtccggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggrctgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgagcgccatgcctagagataggcagttctcttcggagacgtgaaaacaggtggtgcatggctgtcgtcagctcgtgtcgtgagatrttgggttaagtcccgcaacgagcgcaacccctattctatgttaccagcacgttatggtggggactcataggagactgccaaggacaacttggaggaaggcggggatgacgtcaagtcatcatgccccttatgtcttgggctacacacgtactacaatggtcggcaacagagggaagcgaagccgcgaggcagagcaaaccccagaaacccgatctcagttcggatcgcaggctgcaacccgcctgcgtgaagtcggaatcgctagtaatcgcaggtcagcatactgcggtgaatacgttcccgggccttgtacacaccgcccgtcacaccacgaaagttggaaacacccgaagccggtggggtaacctttaaaaggagccagccgtctaaggtggggccgatkwttggggtgaagtcgkaamaag

SEQ ID NO: 28 - DNA, 1451 bp, Artificial Sequence
  Synthetic Polynucleotide
  misc_feature (18)..(18): n is a, c, g, or t
  misc_feature (30)..(30): n is a, c, g, or t
  misc_feature (33)..(33): n is a, c, g, or t
  misc_feature (1048)..(1048): n is a, c, g, or t
  misc_feature (1054)..(1054): n is a, c, g, or t
  misc_feature (1057)..(1057): n is a, c, g, or t
  misc_feature (1235)..(1235): n is a, c, g, or t
aggatgaacgctagtttncggcttaacacntgnaagtcgaggggcagcggtggagagagcttgctctcttcagccggcgaccggcgcacgggtgagtaacacgtatgcaacctgcccttgacactgggataacccggagaaatccggactaataccgggcgatacctctggaggacatcctccggaggtcgaaggaacgattccggtcaaggatgggcatgcggcgcattagctagttggcggggtaacggcccaccaaggcgacgatgcgtaggggttctgagaggaaggtcccccacattggtactgagacacggaccaaactcctacgggaggcagcagtgaggaatattggtcaatgggcgcgagcctgaaccagccaagtcgcgtgagggaagacggccctgcgggttgtaaacctcttttgtcggggagcaaggactgccacgagtggcagggcgagagtacccgaagaaaaagcatcggctaactccgtgccagccagccgcggtaatacggaggatgcgagcgttatccggatttattgggtttaaagggtgcgtaggcggaagctcaagtcagcggtaaaatcgaggggctcaacccctttaagccgttgaaactgggtttcttgagtgggcgagaagtgtgcggaatgtgtggtgtagcggtgaaatgcatagatatcacacagaactccgattgcgaaggcagcacaccggcgccctactgacgctgaggcacgaaagcgtggggatcaaacaggattagataccctggtagtccacgcagtaaacgatgaacactaggtgtgcgggtcgaatgagatctgcgtgccacagcgaaagcgttaagtgttccacctggggagtacgccggcaacgatgaaactcaaaggaattgacgggggcccgcacaagcggaggaacatgtggtttaattcgatgatacgcgaggaaccttacccgggctcaaacggcagaggaaagtttttgaaaggaggctgctcttaggagtctctgccgaggtgctgcatggttgtcgtcanctaatnccntgaggtgtcggcttaagtgccataacgagcgcaacccctaccgccagttgccatcaggtaaagctggggactctggcgggactgccggcgcaagctgtgaggaaggcggggatgacgtcaaatcagcacggcccttacgtccggggcgacacacgtgttacaatggcaggtacagcgngaagccaccgagcgatcgggagcagaacccgaaaacctgtctcagttcggattggagtctgcaactcgactccatgaagctggattcgctagtaatcgcgcatcagccatggcgcggtgaatacgttcccgggccttgtacacaccgcccgtcaagccatggaagccgggggtgcctgaagtgcgcgaccgcaaggagcgccctaaggtaaaaccg

SEQ ID NO: 29 - DNA, 1451 bp, Artificial Sequence
  Synthetic Polynucleotide
gaacgctggcggcgtgccttacacatgcaagtcgaacggcagcgcgggagcttgctcctggcggcgagtggcgcacgggtgagtaatgcatcggaacgtgtcttcttgtgggggataactgtccgaaaggacagctaataccgcataagacctgagggtgaaagcaggggatcgcaagaccttgcgcaggaagagcggccgatgtccgattagctagttggcggggtaaaggcccaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggacgtgataacaccacgttctgctgacggtacctgaagaataagcaccggctaactacgtgccagcagccgcggtaatacgtagggtgcaagcgttaatcggaattactgggcgtaaagcgtgcgcaggcggttttgtaagatagatgtgaaatccccgggctcaacctgggaattgcatatatgactgcaagacttgagtttgtcagaggagggtggaattccaagtgtagcagtgaaatgcgtagatatttggaagaacaccgatggcgaaggcagccctctgggacatgactgacgctcatgcacgaaagcgtggggagcaaacaggattagataccctggtagtccacgccctaaacgatgtctactagttgttgggagagcaatctcttggtaacgcagctaacgcgtgaagtagaccgcctggggagtacggtcgcaagattaaaactcaaaggaattgacggggacccgcacaagcggtggatgatgtggattaattcgacgcaacgcgaaaaaccttacctagccttgacatgccaggaaccctgaagagattcgggggtgcccgcaagggaatctggacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgcccaaccgaaaggaaggcggcgtccacggtgggcttcatgactggggt

SEQ ID NO: 30 - DNA, 1455 bp, Artificial Sequence
  Synthetic Polynucleotide
tgaacgctagcgacaggcttaacacatgcaagtcgaggggcagcggaggtaaaggcttgcctttacctgccggcgaccggcgcacgggtgagtaacacgtatgcaacctggccgtcacaggaggataaccgggagaaattccgcctaatactccataacacgtggggaggacatccttctcaggtcaaaggaatttattccggtgacggatgggcatgcggcgcattagctagtcggcggggtaacggcccaccgaggcgacgatgcgtaggggttctgagaggaaggtcccccacattggaactgagacacggtccaaactcctacgggaggcagcagtgaggaatattggtcaatgggcggaagcctgaaccagccaagtcgcgtgagggaataaggccctaagggtcgtaaacctcttttgccggggagcaatggtcctcttgcgaggggacagggagagtacccggagaaaaagcatcggctaactccgtgccagcagccgcggtaatacggaggatgcgagcgttatccggatttattgggtttaaagggtgcgtaggcggaccatcaagtcagcggtcaaaagtcggggctcaaccccgtaaagccgttgaaactggtggtcttgagtgagcgagaagcaggcggaatgcgtggtgtagcggtgaaatgcatagatatcacgcagaaccccgattgcgaaggcagcctgccggcgctcaactgacgctgaggcacgaaagtgcggggatcgaacaggattagataccctggtagtccgcacaataaacgatgaatgctagctgtccggtccgaatgaggattgggtggcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgccaccgggatcatctttgaaaggagatgagccagcaatggccggtggcgaggtgctgcatggttgtcgtcagctcgtgccgtgaggtgtcggcttaagtgccataacgagcgcaacccctaccgacagttgctaactggtcaagcagaggactctgtcgggactgccggcgcaagctgcgaggaaggcggggatgacgtcaaatcagcacggcccttacgtccggggcgacacacgtgttacaatggcaggtacagagggaagccacctggcgacagggagcggaacccgaaaacctgtctcagttcggatcggagtctgcaacccgactccgtgaagctggattcgctagtaatcgcgcatcagccatggcgcggtgaatacgttcccaggccttgtacacaccgcccgtcaagccatgggagccgggggtgcctgaaggccgtgaccgcaaggagcggcctagggtaaaaccggtgac

SEQ ID NO: 31 - DNA, 1330 bp, Artificial Sequence
  Synthetic Polynucleotide
agagtttgatcctggctcaggatgaacgctggcggcgcgcctaacacatgcaagtcgaacggcacctgccctcgggcagaagcgagtggcgaacggctgagtaacacgtggagaacctgccccctcccccgggatagccgcccgaaaggacgggtaataccggataccccggggtgccgcatggcacccgggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggatgatcccccctaggggcaaccaacactataagcgtcccgcgtggggagtacggccgcaaggggaaaactcaaaggaattgacgggggcccgcacaagcagcggagcatggggcttaattagaagcaacgcgaagaaccttaccagggacttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggt

SEQ ID NO: 32 - DNA, 1347 bp, Artificial Sequence
  Synthetic Polynucleotide
agagtttgatcctggctcaggacgaacgctggcggcacgcttaacacatgcaagtcgaacggagaatatcgaagcttgctttgatattcttagtggcggacgggtgagtaacacgtgagtaacctgcctctgagagtgggatagcttctggaaacggatggtaataccgcatgaaatcatagtatcgcatggtaccatgatcaaagatttatcgctcagagatggactcgcgtccgattagctagttggtgagataacagcccaccaaggcgacgatcggtagccgacctgagagggtgatcggccacattggaactgagagacggtccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtacaggagaggcaggcggaattcctagtgtagcggtgaaatgcgtagatattaggaggaacaccagtggcgaaggcggctttctggactgaaactgacactgaggcacgaaagcgtggggagcaaacaggattagataccctggtagtccacgccgtaaacgatgaatactaggtgtcggtctagcttagctgttgcgtgccgcagcattagcattaagtattccacttgggggagtgagattgcaagaataaaatgcaaaggaatagaaggggacccgcacaatccgtggagcatgtggtttaatttgaattcagcgagaagaacgtttccaggccttgacatcaaggtgaccgtcctgttatggggacctctgtttggtgcaccggtgacaggtggtgcatggttgttgtcaggttgtgtcgtgagatgttgggttaagtcccgcaacgagcgcaacccctatgttcagtagccagcaggtaaagctgggcactctggacagactgccggggataacccggaggaaggtggggatgacgtcaaatcatcatgccccttactacgtgggctacacacgtgttccaatgggtacaacaaagagaagtgagaccgcacggtggagcaaaactcagaaaagttctctcatttcagatggtggggtgcaacccgcccacaagaagttggagtttttagttatcgcggatgagcatgccgcggtga

SEQ ID NO: 33 - DNA, 1400 bp, Artificial Sequence
  Synthetic Polynucleotide
ttcgcccttagagtttgatcctggctcaggacgaacgctggcggcgtgcttaacacatgcaagtcgaacgaagcgatttaacggaagccttcgggcggaagataaattgacttagtggcggacgggtgagtaacgcgtgagcaacctgcccataagagggggataacagttggaaacgactgctaataccgcataagaccacattaccgcatggtaaaggggtcaaagaaattcgcttatggatgggctcgcgtcccattaggtagttggtagggtaacggcctaccaagccaatgatgggtagccgacctgagagggtgatcggccacactggaactgagacacggtccagactcctacgggaggcagcagtggggaatattgggcaatgggcgcaagcctgacccagcaacgccgcgtgagggaagaaggccttcgggttgtaaacctctgtcctatgggaagaaaaaaatgacggtaccataggaggaagctccggctaactacgtgccagcagccgcggtaatacgtagggagcaagcgttgtccggaattactgggcgtaaagggtgcgtaggcggttgcttaagtcagatgtgaaatactcgggctcaactcgggggctgcatctgatactgggtaactagagtgcaggagaggaaagtggaattcctagtgtagcggtggaatgcgtagatattaggaggaacaccagtggcgaaggcgactttctggactgtaactgacgctgaggcacgaaagtatgggtagcaaacaggattagataccctggtagtccatactgtaaacgatgaatactaggtgtggggggcaatagtcttccgtgccgcagctaacgcaataagtattccgcctggggagtacggtcgcaagactgaaactcaaaggaattgacgggggcccgcacaagcagcggagcatgtggtttaattcgaagcaacgcgaagaaccttaccaaggcttgacatcccggtgaccggcatagagatatgccttctcttcggagcaccggtgacaggtggtgcatggttgtcgtcagctcgtgtcgtgagatgttgggttaagtcccgcaacgagcgcaacccttgttactagttgccagcattacggatgggaactctagtgagactgccggggataactcggaggaaggtggggatgacgtcaaatcatcatgccctttatgtcttgggctacacacgtgctacaatggtcggtacaaagagcggcgaactcgtaagagcaagcgaatctcataaagccggtctcagttcagattgtgggctgcaacccgcccacatgaagtcggagttgctagtaatcgcggatcagcatgccgcggtgaatgcgttcccgggccttgtacacaccgcccgtca

SEQ ID NO: 34 - DNA, 1402 bp, Artificial Sequence
  Synthetic Polynucleotide
agagtttgatcctggctcaggatgaacgctagcggcaggcttaacacatgcaagtcgggcggcagcgggggaagagcttgctcttcctgccggcgagcggcgcacgggtgagtaacacgtatgcaacctgcccttctcagggggacaacccgccgaaaggcgggctaatcccgcgtatatcccctcagggcatcctgaggggaggaaaggagcgatccggagaaggatgggcatgcggcgcattaggcagacggcggggtaacggcccaccgtaccgacgatgcgtaggggttctgagaggaaggtcccccacactggtactgagacacggaccacactcctacgggaggcagcagtgaggaatattggtcaatggtcgggagactgaaccagccaagccgcgtgagggaagaaggtacagagtatcggaaacctcttttgtcacggaacaaagacggggacgtgtccccggatgagtgtacctgaagaaaaagcatcggctaactccgtgccagcagccgcggtaatacggaggatgcgagcgttatccggatttattgggtttaaagggtgcgcaggcggattgttaagtcagcggtcaaagcccggggctcaaccctggcccgccgttgaaactggcgatctggagttggagagaagtatgcggaatgcgcggtgtagcggtgaaatgcatagatatcgcgcagaactccgattgcgaaggcagcataccggctccatactgacgctgaggcacgaaagcgtgggtatcgaacaggattagataccctggtagtccacgcagtaaacgatgaatgctggctgtccggagggaatgacctctgggtggcgaagcgaaagcgataagcatcccacctggggagtacgccggcaacggtgaaactcaaaggaattgacgggggcccgcacaagcggaggaacatgtggtttaattcgatgatacgcgaggaaccttacccgggctcaaacgggagatgccgtcagcagagacgctgatttcctacgggacatcttccgaggtgctgcatgattgtcgtcagctcgtgccgtgaggtgtcggcttaagtgccataacgagcgcaacccctgcgggcagttgctaacagtataagctgaggactctgcccggactgccggcgcaagccgtgaggaaggcggggatgacgtcaaatcagcacggcccttacgtccggggcgacacacgtgttacaatgggtggtacagcgggaagccaggtggcgacaccgagcggaacccgaaaaccactctcagttcggatcggagtctgcaacccgactccgtgaagctggattcgctagtaatcgcgcaccagccatggcgcggtgaatacgttcccggcccttgtacacaccgcccgtca

SEQ ID NO: 35 - DNA, 1401 bp, Artificial Sequence
  Synthetic Polynucleotide
agagtttgatcctggctcaggatgttcgctagcgacaggcttaacacatgcaagtcgaggggcagcaggggcgtagcaatacgcctgctggcgaccggcgcacgggtgagtaacacgtatgaaacctgcccgtagcagggggataagcggaagaaattccgtctagtaccgcgtaataaccgtttggggcatcccttaaggtttaaaggagcgatccggctacggatggtcatgcgtcgcattagctagtcgacggggtaacggcccaccgaggcgacgatgcgtaggggttctgagaggaaggtcccccacactggtactgagacacggaccagactcctacgggaggcagcagtgaggaatattggtcaatggccggaaggctgaaccagccaagtcgcgtgagggaagacggccctatgggttgtaaacctcttttgtcggggagcaaaggccgccacgcgtggcggattgagagtacccgaagaaaaagcatcggctaactccgtgccagcagccgcggtaatacggaggatgcgagcgttatccggatttattgggtttaaagggtgcgcaggcggaaggtcaagtcagcggtaaaatgtcggggctcaaccccggccggccgttgaaactggtcatctagagttggagagaagtatgcggaattcgtggtgtagcggtgaaatgcatagatatcacgaagaactccgattgcgaaggcagcataccggctccatactgacgctcaggcacgaaagcgtggggatcgaacaggattagataccctggtagtccacgcagtaaacgatgaatgctcggtgttcggtaagaatgattactgagtgccatagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgtagcaggacgtacgccgaaaagcgcatttcacttgtgacctgttacgaggtgctgcatggttgtcgtcagctcgtgccgtgaggtgtcggcttaagtgccataacgagcgcaacccctgccgccagttgctaacgcgaaaaggcgaggactctggcgggactgccggcgcaagccgtgaggaaggcggggatgacgtcaaatcagcacggcccttacgtccggggcgacacacgtgttacaatggggggcacagcgggaagccacttggtgacaaggagcagaaccccaaagcctctctcagttcggattggagtctgcaacccgactccatgaagctggattcgctagtaatcgcgcatcagccatggcgcggtgaatacgttcccgggccttgcactcaccgcccgtca

SEQ ID NO: 36 - DNA, 1405 bp, Artificial Sequence
  Synthetic Polynucleotide
agagtttgatcctggctcaggacgaacgctggcggcgcgcctaacacatgcaagtcgaacggagcttagagagcttgctttttaagcttagtggcgaacgggtgagtaacgcgtgagtaacctgccctagagtgggggacaacagttggaaacgactgctaataccgcataagcccacggtaccgcatggtactgagggaaaaggatttattcgctttaggatggactcgcgtccaattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaacgtgcagattgtaaataatgatctgtaatgacggtagtaaacgaataagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagctagggtagcgaacgggattagataccccggtagtcctggccgtaaacgatgggtactaggtgtaggaggtatcgtccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgaatgaccgctccagagatggagctttcccttcggggacatgaaaacaggtggtgcatggctgtcgtcagctcgtgtcatgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcggcaacagagggaagcgaagccgtgaggcagagcaaaccccagaaacccgatctcagttcggattgcaggctgcaactcgcctgcatgaagtcggaatcgctagtaatcgcaggccagcatactgcggtgaatacgtaagcgggccttgcacacaccgcccgtca

SEQ ID NO: 37 - DNA, 1409 bp, Artificial Sequence
  Synthetic Polynucleotide
agagtttgatcctggctcaggacgaacgctggcggcgtgcctaacacatgcaagtcgaacggagaattttatttcggtagaattcttagtggcgaacgggtgagtaacgcgtaggcaacctaccctttagacggggacaacattccgaaaggagtgctaataccggatgtgatcatcgtgccgcatggcaggatgaagaaagatggcctctacaagtaagctatcgctaaaggatgggcctgcgtctgattagctagttggtagtgtaacggactaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggatttcggtctgtaaagctctgttgtttatgacgaacgtgcagtgtgtgaacaatgcattgcaatgacggtagtaaacgaggaagccacggctaactacgtgccaccagccgcggtaatacgtaggtggcgagcgttgtccggaattattgggcgtaaagagcatgtaggcggcttaataagtcgagcgtgaaaatgcggggctcaaccccgtatggcgctggaaactgttaggcttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgaagcaacgcgaagaaccttaccaggtcttgacatcccgatgaccgccttagagataaggcttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtgctacaatggcgtaaacaaagggaagcgaacctgcgagggtgggcaaatcccaaaaataacgtcccagttcggactgtagtctgcaacccgactacacgaagctggaatcgctagtaatcgcagatcagaatgctgcggtgaatacgttcccgggtcttgtactcaccgcccgtca

SEQ ID NO: 38 - DNA, 1400 bp, Artificial Sequence
  Synthetic Polynucleotide
agagtttgatcctggctcaggacgaacgctggcggcgcgcctaacacatgcaagtcgaacgagcgagagagagcttgctttctcgagcgagtggcgaacgggtgagtaacgcgtgaggaacctgcctcaaagagggggacaacagttggaaacgactgctaataccgcataagcccacaggtcggcatcgaccagagggaaaaggagcaatccgctttgagatggcctcgcgtccgattagctagttggtgaggtaacggcccaccaaggcaacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaaggttgaaactcaaaggaattgacgggggcccgcacaagcggtggagtatgtggtttaattcgaagcaacgcgaagaaccttaccagggcttgacatcgtactaacgaagcagagatgcattaggtgcccttcggggaaagtatagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggcggtcaacagagggaggcaataccgcgaggtggagcaaatccctaaaagccgtcccagttcggattgcaggctgaaacccgcctgcatgaagttggaatcgctagtaatcgcggatcagcatgccgcggtgaatacgttcccgggccttgcactcaccgcccgtca

SEQ ID NO: 39 - DNA, 1386 bp, Artificial Sequence
  Synthetic Polynucleotide
ttcgcccttagagtttgatcctggctcaggacgaacgctggcggcgcgcctaacacatgcaagtcgaacggagataaagatttcggtttttatcttagtggcgcacgggtgagtaacacgtgaataacctgacccaaagagggggataacacctggaaacaggtgctaataccgcataagaccacaatgtcgcatgacgaaggggtcaaagaaaatcgctttgggaggggttcgcgtcccattaggtagtaggcggggtaacggcccacctagccgacgatgggtagccgagctgagaggctgatcggccacactggaactgagactcggtccagactcctacgggaggcagcagtggggaatattgggcaatgggcgcaagcctgacccagcaacgccgcgtgagggaagaaggttttcggattgtaaacctctgtcgcagaagacgaaggaagtgacggtattctgtgaggaagccccggctaactacgtgccagcagccgcggtaatacgtagggggcgagcgttgtccggaattactgggcgtaaagggagcgtaggcggtctgataagttggatgtgaaatacccgggcttaacttggggggtgcatccaatactgttggactagagtacaggagaggaaagcggaattcctagtgtagcggtgaaatgcatagatattaggaggaacatcggtggcgaaggcggctttctggactgcaactgacgctgaggctcgaaagcgtggggagcaaacaggattagataccctggtagtccacgctgtaaacgatgaatattaggtgtagggggtagaaactccctctgtgccgcagcaaacgcaataagtattccgcctggggagtatggccgcaaggttgaaactcaaaggaattaacgggggcccgcacacagcagcggagcatgtggtttaattcttcacaacgagaagaaccttaccaaggcttgacatccacttaaagttatggaaacataatgtcctttcgtgggaagtgagacaggtggtgcatggttgtcgtcagctcgtgtcgtgagatgttgggttaagtcctgcaacgagcgcaacccctgttgccagttgccagcaagtaaagttggggactctggtgagactgccggggacaactcggaggaaggtggggaggacgtcaaatcatcatgccccttatgtcttggggtacacacgtgctacaatggctgtaacaaagggaagggaccttgtaagaggaagcggatctcagaaaagcagtcccagttcggattgtgggctgcaacccgcccacatgaagtcggagttgctagtaatcgcggatcagcatgccgcggtgaatacgttcccgggccttgcacacaccgcccgtca

SEQ ID NO: 40 - DNA, 1391 bp, Artificial Sequence
  Synthetic Polynucleotide
agagtttgatcctggctcaggatgaacgctggcggcgtgcttaacacatgcaagtcgaacgaagcacctgactacgatttcttcggaatgacggtcttgtgactgagtggcggacgggtgagtaacgcgtgggtaacctacctcacacaggggaataacagttagaaatgactgctaataccgcataagcgcacggtaccgcatggtacagtgtgaaaaactccggtggtgtgagatggacccgcgtctgattagctggttggtgaggtaacggctcaccaaggcaacgatcagtagccggcctgagagggtgaacggccacattggaactgagacacggtccaaactcctacgggaggcagcagtggggaatattgcacaatgggggaaaccctgatgcagcgacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtcctttccttcgggacagtggagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagcatgccgcggtgaatacgttcccgggccttgtacacaccgcccgtca

SEQ ID NO: 41 - DNA, 1363 bp, Artificial Sequence
  Synthetic Polynucleotide
agagtttgatcctggctcaggatgaacgctggcggcgtgcttaacacatgcaagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacagtaccacatggtacagtgtgaaaaactccggtggtatgagatggatccgcgtctgattagctagttggcggggtaacggcccaccaaggcgacgatcagtagccgacctgagagggtgaccggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaagtgacggtacctgactaagaagctccggctaaatacgtgccagcagccgcggtaatacgtatggagcaagcgttatccggatttactgggtgtaaagggagtgcaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataaagtgctccggtgccgcagcaacgcaaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagtttggctgggcactctagggagactgccagggataacctggaggaaggtggggatgacgtcaaatcatcatgccccttatgacttgggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaata

SEQ ID NO: 42 - DNA, 1392 bp, Artificial Sequence
  Synthetic Polynucleotide
agagtttgatcctggctcaggatgaacgctggcggcgtgcttaacacatgcaagtcgaacgaagcatttaaaacggattttttcggaatgaagttttttatgactgagtggcggacgggtgagtaacgcgtgggtaacctgcctcacacagggggatagcagttggaaacgactggtaataccgcataagcgcacagcttcgcatgaagcggtgtgaaaaactccggtggtgtgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcagcagggaagacagtgacggtacctgactaagaagctccggctaaatacgtgccagcagccgcggtaatacgtatggagcaagcgttatccggatttactgggtgtaaagggagtgtaggtggtatcacaagtcagaagtgaaagcccggggctcaaccccgggactgcttttgaaactgtggaactggagtgcaggagaggtaagtggaattcctagtgtagcggtgaaatgcgtagatattaggaggaacaccagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtatgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgcacacaccgcccgtca

SEQ ID NO: 43 - DNA, 1359 bp, Artificial Sequence
  Synthetic Polynucleotide
agagtttgatcctggctcaggatgaacgctggcggcgtgcctaacacatgcaagtcgagcgattctcttcggagaagagcggcggacgggtgagtaacgcgtgggtaacctgccctgtacacacggataacataccgaaaggtatgctaatacgagataatatgcttttatcgcatggtagaagtatcaaagctccggcggtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggaagaaggcctttgggtcgtaaacttctgttctaagggaagaaagaagacggtaccttaggagcaagtcccggctaactacgtgccagcagccgcggtaatacgtagggggcaagcgttatccggaattattgggcgtaaagagtacgtaggtggttacctaagcacggggtttaaggctatggcttaactatagttcgccttgtgaactgggctacttgagtgcaggagaggaaagcggaattcctagtgtagcggtgaaatgcgtagatattaggaggaacaccagtggcgaaggcggctttctggactgtaactgacactgaggtacgaaagcgtggggagcaaacaggattagataccctggtagtccacgccgtaaacgatgagcactaggtgtcggggtcgcaagacttcggtgccgcagttaacgcaataagtgctccgcctggggagtacgttcgcaagaatgaaactcaaaggaattgacggggacccgcacaagcagcggagcatgtggtttaattcgaagcaacgcgaagaaccttaccaaggcttgacatctccctgacaggtccttaaacggatctttctacggacagggaagacaggtggtgcatggttgtcgtcagctcgtgtcgtgagatgttgggttaagtcccgcaacgagcgcaacccttgtcattagttgccatcagataagctgggcactctaatgagactgccggggacaactcggaggaaggtggggatgacgtcaaatcatcatgccccttatgttctgggctacacacgtgctacaatggtcggtacaaagagaagcgagaccgcgaggtggagcaaatctcaaaaaccgatcccagttcggattgcaggctgcaactcgcctgcatgaagtcggagttgctagtaatcgcagatcagaatgctgcggtgaatgcgttcccgggtcttgcacacaccgcccgtca

SEQ ID NO: 44 - DNA, 1388 bp, Artificial Sequence
  Synthetic Polynucleotide
ttcgcccttagagtttgatcctggctcaggacgaacgctggcggcgtgcctaacacatgcaagtcgaacggagatatttatttcggtagatatcttagtggcgcacgggtgagtaacgcgtgaataacctgacccgaagagggggataacacctggaaacaagtgctaataccgcataagaccacggaccggcatcggtcagaggtcaaaggagaaatccgctttgggaggggttcgcgtcccattaggtagttggtgaggtaacggcccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcaggggacgaaggaagtgacggtaccctgtaagaaagccccggctaactacgtgccagcagccgcggtaatacgtagggggcgagcgttgtccggaattactgggcgtaaagggagcgtaggcggtcgattaagttagatgtgaaacccccgggcttaacttggggactgcatctaatactggttgacttagagtacaggagagggaagcggaattcctagtgtagcggtgaaatgcgtagatattaggaggaacaccagtggcgaaggcggctttctggactgacactgacgctgaggctcgaaagcgtggggagcaaacaggattagataccctggtagtccacgctgtaaacgatgaatactaggtgtagggggtatcaactccctctgtgccgcagcaaacgcaataagtattccgcctggggagtacggccgcaaggttgaaactcaaaggaattgacgggggcccgcacaagcagcggagcatgtggtttaattcgacgcaacgcgaagaaccttaccaaggcttgacatctacttaaagtcatggaaacatgatgtctcttcggaggaagtaagacaggtggtgcatggttgtcgtcagctcgtgtcgtgagatgttgggttaagtcccgcaacgagcgcaacccttatctttagtagccagcggtccggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgcacacaccgcccgtca

SEQ ID NO: 45 - DNA, 1398 bp, Artificial Sequence
  Synthetic Polynucleotide
agtttgatcctggctcaggatgaacgctagcgacaggcctaacacatgcaagtcgaggggcagcggggaggtagcaatacctttgccggcgaccggcgcacgggtgagtaacacgtatgcaatccacctgtaacagggggataacccggagaaatccggactaataccccataatatgggcgctccgcatggagagtccattaaagagagcaatcttggttacagacgagcatgcgctccattagccagttggcggggtaacggcccaccaaggcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtgcgctacgcgtagcgtattgcaagtatccgaagaaaaagcatcggctaactccgtgccagcagccgcggtaatacggaggatgcgagcgttatctggatttattgggtttaaagggtgcgtaggcggcacgccaagtcagcggtgaaatttccgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatatatatgaaagtatatagctagcaatagtcacccgcgaggtgctgcatggttgtcgtcagctcgtgccgtgaggtgtcggcttaagtgccataacgagcgcaacccttatcactagttactaacaggtgaagctgtggactctggtgagactgccagcgtaagctgtgaggaaggtggggatgacgtcaaatcagcacggcccttacatccggggcgacacacgtgttacaatggcatggacaaagggcagctacctggcgacaggatgctaatctccaaaccatgtctcagttcggatcggagtctgcaactcgactccgtgaagctggattcgctagtaatcgcgcatcagccatggcgcggtgaatacgttcccgggccttgtactcacagcccgtca

SEQ ID NO: 46 - DNA, 1407 bp, Artificial Sequence
  Synthetic Polynucleotide
agagtttgatcctggctcaggatgaactctagcgacaggcctaacacatgcaagtcgaggggcatcggggcgaggagcaatccttgccgccggcgaccggcgcacgggtgagtaacacgtatgcgacctgcccgttgcagggggataatcggaagaaatcccgtctaataccgcgtaacatctctcgggtgcatggcccagcgatcaaaggaagcgattccggctacggatgggcatgcgtgacattagctagttggcggggcaacggcccaccaaggcgacgatgtgtaggggttctgagaggaaggtcccccacactggtactgagacacggaccagactcctacgggaggcagcagtgaggaatattggtcaatgggcgagagcctgaaccagccaagtcgcgtgagggatgacggccctacggattgtaaacctcttttgtcggggagcaaattcgccctaggggggccgcaatcgagagtacccgaagaaaaagcatcggctaactccgtgccagcagccgcggtaatacggaggatgcgagcgttatccggatttattgggtttaaagggtgcgtaggcggactgtcaagtcagcggtaaaataggggggctcagcctctgtccgccgttgaaactgtcggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatactagttgtccggtgagaatgatccctgggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgtagaatgacagacggtgaaagccgttctcccttcggggcagtctacgaggtgctgcatggttgtcgtcagctcgtgccgtgaggtgtcggcttaagtgccataacgagcgcaacccccatcgacagttgctaacaggtaaggctgaggactctgtggagactgccggcgcaagctgtgaggaaggcggggatgacgtcaaatcagcacggcccttacgtccggggcgacacacgtgttacaatggcaggtacagcgggaagccacctggcgacagggagcggaacccgaaaacctgtctcagttcggattggagtctgcaacccgactccatgaagctggattcgctagtaatcgcgcatcagccacggcgcggtgaatacgttcccgggccttgcactcaccgcccgtca

SEQ ID NO: 47 - DNA, 1364 bp, Artificial Sequence
  Synthetic Polynucleotide
agagtttgatcctcggctcaggatgaacgctggcggcgtgcgtaacacatgcaagtcgagcgagaagctcatgacggacgcttcggttgaagtcacgagtgaatagcggcggacgcgtgagtaacgcgtaggcaacctgccctctgcagagggatagcctcgcgaaaccgggattaaaacctcataataccgcagtgagacatctcgcggcggtcaaagatttatcggcaaaggatgggcctgcgtctgattagttagttggtggtggtaacggcctaccaaggcgacgatcagtagccgacctgagagggtgatcggccacattggaactgagacacggtccaaactcgtaccggaggcagcagtggggaatattgcacaatgggggaaaccctgatgcagcaacgccgcgtgaagtatgaaggcctttgggtcgtaaacttctgttctaagggaagatagtgacggtaccttaggagcaagtcccggctaactacgtgccagcagccgcggtaatacgtagggggcaagcgttatccggaattattgggcgtaaagagtacgtaggtggttttataagcacggggtttaaggcaatggcttaaccattgttcgccttgtgaactggaagacttgagtgcaggagaggaaagcggaattcctagtgtagcggtgaaatgcgtagatattaggaggaactccagtggcgaaggcggctttctggactgtaactgacactgaggtacgaaagcgtggggagcaaacgaggattagataccctggtagtccacgccgtaaacgatgagcactaggtgtcggggtcgcaagacttcggtgcagcagttaccgcattaagtgctcggattggggagtacgttcgcaagaatgaaactcaaaggaattgaggcggagagcacacagtatcgtagtatgtggtttaattcgaagcaacgcgatgacccttgccagggcttgacattcctaagacagatctttaaacggatgttttttcggacagaggagacaggtcgtgcagagtggttgtcagctggtgtcgcgagaaggtgtgtgaagtccgtcaaagagcgcaaccgtcgtcacaagttgtcagcaggaagatgggcaatctcgtgagagagccggggattactcggaggaaggaggggacgaggtcccatcatcaagcccattatggtttgggttacacaagtgttacaaggaccggcaccgagagaacccggaccgcgaggtggagcaaaaatcaaaagccggtcccagttaggagtgcagcatgcaagtagcatgcacgaagtaggagttgttagtaatggcagatcagaatgatgcggtgaacgagttcccgg

SEQ ID NO: 48 - DNA, 1392 bp, Artificial Sequence
  Synthetic Polynucleotide
agagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacgcggcccaaactcctacgggaggcagcagtggggaatattgcacaatgggcgaaagcctgatgcagcgacgccgcgtgagcgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcgggtgacgaagtcattcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagttcggctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgcactcaccgcccgtca

SEQ ID NO: 49 - DNA, 1392 bp, Artificial Sequence
  Synthetic Polynucleotide
agagtttgatcctggctcaagatgaacgctggcggcgtgcttaacacatgcaagtcgaacgaagcatttgcgacagatttcttcgggatgaagttgcttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccgcgccgtaaacgatgaatactaggtgtcggggagcaaagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagccttgacatcccattgacagagcatgtaatgtgctttcccttcggggcagtggtgacaggtggtgcatggttgtcgtcagctcgtgtcgtgagatgttgggttaagtcccgcaacgagcgcaacccctatcttcagtagccagcggttcggccgggcactctggagagactgccagggacaacctggaggaaggtggggatgacgtcaaatcatcatgccccttatggcttgggctacacacgtgctacaatggcgtaaacaaagggaagcgagcctgcgagggggagcaaatcccaaaaataacgtctcagttcggattgtagtctgcaactcgactacatgaagctggaatcgctagtaatcgcgaatcagaatgtcgcggtgaatacgttcccgggtcttgcacacaccgcccgtca

SEQ ID NO: 50 - DNA, 1403 bp, Artificial Sequence
  Synthetic Polynucleotide
agagtttgatcctggctcaggatgaacgctagcgacaggcttaacacatgcaagtcgaggggcagcggggaggtagcaatacttccgccggcgaccggcgcacgggtgagtaacacgaatggaacctgcccgtagcagggggataagcggaagaaattccgtctaataccgcgtaataactccgagaggcatctcatggagtttaaagggtaataccggctacggatggccatgcggcgcattagctagctggcggggtaacggcccaccaaggcgacgatgcgtaggggttctgagaggaaggtcccccacactggtactgagacacggaccagactcctacgggaggcagcagtgaggaatattggtcaatggccgagaggctgaaccagccaagtcgcgtgagggatgacggccctacgggttgtaaacctcttttgccggggagcaaagagcgggacgcgtcccgcctcgagagtacccggagaaaaagcatcggctaactccgtgccagcagccgcggtaatacggaggatgcgagcgttatccggatttattgggtttaaagggtgcgtaggcggcctgccaagtcagcggtaaaattgcggggctcaaccccgtacagccgttgaaactgccgggctcgagtgggcgagaagtatgcggaatgcgtggtgtagcggtgaaatgcatagatatcacgcagaaccccgattgcgaaggcagcataccggcgcccgactgacgctgaggcacgaaagtgcggggatcaaacaggattagataccctggtagtccgcacagtaaacgatgaatgctagctgtccgtggggattgacccctgggtggcacagcgaaagcgttaagcattccacctggggagtacgccggcaacggtgaaactcaaaggaattgacggggccccgcacaagcggaggaacatgtggtttaattcgatgatacgcgaggaaccttacccgggctcaaacgccgaagggacattccccgaaaggggattggccagcaatggtcttcggcgaggtgctgcatggttgtcgtcagctcgtgccgtgaggtgtcggcttaagtgccataacgagcgcaacccccaccgacagttgctaactggtcaagcagaggactctgtcgggactgccggcgcaagctgcgaggaaggcggggatgacgtcaaatcagcacggcccttacgtccggggcgacacacgtgttacaatggcaggtacagcgggatgccatggggcgacccagagcggaacccgaaaacctgtctcagttcggattggagtctgcaacccgactccatgaagctgggttcgctagtaatcgcgcatcagccacggcgcggtgaatacgttcccgggccttgcacacaccgcccgtca

SEQ ID NO: 51 - DNA, 1398 bp, Artificial Sequence
  Synthetic Polynucleotide
agagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtctcccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtacgctgcgtgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaattttcgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatatatatgaaagtatatagctagcaatagtcacctgcgaggtgctgcatggttgtcgtcagctcgtgccgtgaggtgtcggcttaagtgccataacgagcgcaacccctatcgacagttactaacgggtgaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgcacacaccgcccgtca

SEQ ID NO: 52 - DNA, 1383 bp, Artificial Sequence
  Synthetic Polynucleotide
ttcgcccttagagtttgatcctggctcaggacgaacgctggcggcgtgcctaacacatgcaagtcgaacggagatgtttatttcggtagatatcttagtggcgcacgggtgagtaacgcgtgaataacctgacccgaagagggggataacacctggaaacaagtgctaataccgcataagaccacggaccggcatcggtcagaggtcaaaggaggaatccgctttgggaggggttcgcgtcccattaggtagttggtgaggtaacggcccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcaggggacgaaggaagtgacggtaccctgtaagaaagccccggctaactacgtgccagcagccgcggtaatacgtagggggcgagcgttgtccggaattactgggcgtaaagggagcgtaggcggtcgattaagttagatgtgaaacccccgggcttaacttggggactgcatctaatactggttgacttagagtacaggagagggaagcggaattcctagtgtagcggtgaaatgcgtagatattaggaggaacaccagtggcgaaggcggctttctggactgacactgacgctgaggctcgaaagcgtggggagcaaacaggattagataccctggtagtccatgccgtaaacgatgattactaggtgttgggggattgaccccctcagtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccgatgcatagcacagagatgtgtgaaatccttcgggacatcgagacaggtggtgcatggttgtcgtcagctcgtgtcgtgagatgttgggttaagtcccgcaacgagcgcaacccttattgccagttactacgttaagaggactctggcgagactgccgttgacaaaacggaggaaggtggggatgacgtcaaatcatcatgccctttatgacctgggctacacacgtactacaatggcgttaaacaaagagaagcaagaccgcgaggtggagcaaaactcaaaaacaacgtctcagttcagattgcaggctgcaactcgcctgcatgaagtcggaattgctagtaatcgcggatcagcatgccgcggtgaatacgttcccgggccttgtacacaccgcccgtca

SEQ ID NO: 53 - DNA, 1393 bp, Artificial Sequence
  Synthetic Polynucleotide
agagtttgatcctggctcaggatgaacgctggcggcgtgcttaacacatgcaagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacggtatcgcatgatacagtgtgaaaaactccggtggtatgagatggacccgcgtctgattagctggttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttcccttcggggcagtggagacaggtggtgcatggttgtcgtcagctcgtgtcgtgagatgttgggttaagtcccgcaacgagcgcaacccttattcttagtagccagcagttcggctgggcactctagggagactgccagggataacctggaggaaggtggggatgacgtcaaatcatcatgccccttatgacttgggctacacacgtgctacaatggctgtaacaaagggaagcgaccccgtaaggggaagcggatctcagaaaagcagtctcagttcggattgtgggctgcaacccgcccacatgaagttggagttgctagtaatcgcggatcagcatgccgcggtgaatacgttcccgggccttgcacacaccgcccgtca

SEQ ID NO: 54 - DNA, 1400 bp, Artificial Sequence
  Synthetic Polynucleotide
ttcgcccttagagtttgatcctggctcaggacgaacgctggcggcgtgcctaacacatgcaagtcgaacggggatcatgaagcggaagttttcggatggaaggttcatgattctagtggcgcacgggtgagtaacgcgtgaacaacctgcctttcagtgggggataacacctggaaacaagtgctaataccgcatgagaccacgacctggcatcgggatggggtcaaagatttatcgctgaaagaggggttcgcgtcccattaggtagttggtgagataacagcccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcaggggacgaaggaagtgacggtaccctgtaagaaagccccggctaactacgtgccagcagccgcggtaatacgtagggggcgagcgttgtccggaattactgggcgtaaagggagcgtaggcggtcgattaagttagatgtgaaacccccgggcttaacttggggactgcatctaatactggttgacttagagtacaggagagggaagcggaattcccagtgtagcggtgaaatgcgtagatattcggaggaacaccagtggcgaaggcggcctgctgggctttaactgacgctgaggctcgaaagtgtggggagcaaacaggattagataccctggtagtccacactgtaaacgatgattgctaggtgtggggggtctgaccccttccgtgccggagttaacgcaataagcaatccacctggggagtacggccgcaaggttgaaactcaaaggaattgacgggggcccgcacaagcagtggattatgtggtttaattcgacgcaacgcgaagaaccttaccaggtcttgacatccaacgaatccttaagagattagggagtgcctttcggggaacgttgagacaggtggtgcatggttgtcgtcagctcgtgtcgtgagatgttgggttaagtcccgcaacgagcgcaacccctgccattagttgctacgcaagagcactctaatgggaccgctaccgacaaggtggaggaaggtggggacgacgtcaaatcatcatgccccttatgacctgggctacacacgtaatacaatggccgttaacaacgggaggcaaaaccgcgaggtggagcaaaaccctaaaaacggtcccagttcggatcgcaggctgcaacccgcctgcgtgaagttggaattgctagtaatcgcggatcagcatgccgcggtgaatacgttcccgggccttgtacacaccgcccgtca

SEQ ID NO: 55 - DNA, 1403 bp, Artificial Sequence
  Synthetic Polynucleotide
agagtttgatcctggctcaggatgaacgctagcgacaggcttaacacatgcaagtcgaggggcagcgcggtggtggcaacaccaccggcggcgaccggcgcacgggtgagtaacacgtatgcaacctgccctccacagggggataatcgggagaaatcccgtctaataccgcataacgccaaccgggggcatccccggttggccaaaggagcgatccggtgggggctgggcatgcgccgcattagccagttggcggggtaacggcccaccaaggcgacgatgcgtaggggttctgagaggaaggtcccccacactggtactgagacacggaccagactcctacgggaggcagcagtgaggaatattggtcaatgggcggaagcctgaaccagccaagtcgcgtgagggaagacggtcctatggattgtaaacctcttttgtcggggagcaaggggcgccacgagtggcgtcaagcgagagtacccgaagaaaaagcatcggctaactccgtgccagcagccgcggtaatacggaggatgcgagcgttatccggatttattgggtttaaagggtgcgtaggcgggacgccaagtcagcggtaaaatgtcggggctcaaccccgttgtgccgttgaaactggcgttcttgagtgggcgagaagtatgcggaatgcgtggtgtagcggtgaaatgcatagatatcacgcagaactccgattgcgaaggcagcataccggcgccctactgacgctgaagcacgaaagcgtgggtatcaaacaggcttagataccctggtagtccacgcagtaaacgatgaacactaattgtccggcgcgaatgagcgctgggtgatacagcgaaagcgttaagtgttccacctggggagtacgccggcaacggtgaaactcaaaggaattgacgggggcccgcacaagcggaggaacatgtggtttaattcgatgatacgcgaggaaccttacccgggctcaaacgacgcaggaatgtttttgaaaggaggcagcccttcggggcctgcgtcgaggtgctgcatggttgtcgtcagctcgtgccgtgaggtgtcggcttaagtgccataacgagcgcaacccccattgacagttgctaacaggtaaagctgaggactctgtcgagactgccggcgcaagctgtgaggaaggcggggatgacgtcaaatcagcacggcccttacgtccggggcgacacacgtgttacaatggcaggtacagcgggaggccacctggcgacagggagcggaacccgaaagcctgtctcagttcggattggagtctgcaacccgactccatgaagctggattcgctagtaatcgcgcatcagccacggcgcggtgaatacgttcccgggccttgcactcaccgcccgtca

SEQ ID NO: 56 - DNA, 1371 bp, Artificial Sequence
  Synthetic Polynucleotide
agagtttgatcctggctcaggatgaattttggccgcccgcctaatacttgccagtcgaacggcacccctctcctgagggaagcgagtggagaacggctgattaacacggggagaacctgccccctcccccgggacagccgcccgaaaggacgggtaataccagatacccccggggtgctgcatggcaccccggcttaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacactaggtgtggggggacggatcccctccgttccgcagccaacgcattaagagtttccgcctggggagtacgcccgcaaggttaaaactcaaaggaattgacgggggcccgcacacgcggcggaacatgtggtttaatttgaagcaacgggaagagccttaccagggcttgacatatggtgtgaagcgggggagaccccgtggccgagaggagcccatacaggtggtgcatggctgtcgtctgctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgcacacaccgcccgtca

SEQ ID NO: 57 - DNA, 1393 bp, Artificial Sequence
  Synthetic Polynucleotide
atcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattaaaaccgcatggttttactattaaagaatttcggttatcgatgggatgcgttccattagtttgttggcggggtaacggcccaccaagactacgatggataggggttctgagaggaaggtcccccacattggaactgagacacggtccaaactcctacggggggcagcagtgaggaatattggtcaatggacgagagtctgaaccagccaagtagcgtgaaggatgactgccctatgggttgtaaacttcttttatatgggaataaagtattccacgtgtgggattttgtatgtaccatatgaataaggatcggctaactccgtgccagcagccgcggtaatacggaggatgcgagcgttatccggatttattgggtttaaagggtgcgtaggcggcacgccaagtcagcggtgaaatttccgggctcaacccggagtgtgccgttgaaactggcgagctagagtacacaagaggcaggcggaatgcgtggtgtagcggtgaaatgcatagatatcacgcagaaccccgattgcgaaggcagcctgctagggtgaaacagacgctgaggcacgaaagcgtgggtatcgaacaggattagataccctggtagtccacgcagtaaacgatgaataactaactgtttgcgatacaatgtaagcggtacagcgaaagcgttaagtattccacctggggagtacgccggcaacggtgaaactcaaaggaatttgacgggggcccgcacaaagcggaggaacatgtggtttaattcgatgatacgcgaggaaccttacccgggctcaaacgcagggggaatgtcggtgaaagccggcagctagtaatagtcacctgcgaggtgctgcatggttgtcgtcagctcgtgccgtgaggtgtcggcttaagtgccataacgagcgcaacccctatcgacagttactaacgggtgaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccataaagctggattcgctagtaatcgcgcatcagccatggcgcggtgaatacgttcccgggccttgcactcaccgcccgtca

SEQ ID NO: 58 - DNA, 1373 bp, Artificial Sequence
  Synthetic Polynucleotide
agtttgatcctggctcaggatgaacgcttgcggcgtgcctaacacatgcaagtcgaacgatgaaaccgcccccgggcggacatgaagtggcgaacgggtgagtaacacgtgaccgacctgccccccgcccagggacagccccccgaaagggggattaatacctggtactccggaagcggcgcatgccgcccccgggaaagctctggcggcgggggatggggtcgcggcccatcaggtagacggcggggcagaggcccaccgtgccgacgacgggtagccgggttgagagaccgaccggccacattgggactgagatacggcccagactcctacgggaggcagcagtggggaattttgcgcaatgggggcaaccctgacgcagcaacgccgcgtgaaggaagaagtatctcggtatgtaaacttctatcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacactaggtgtgggggggacgatcccccccgttacggaggccaaaccattaagggtccgcgccgggggagtaccggccgcaaggctaaaactaaaaggaatggacgggggcccgcacaagcagcggagcatgtggcttaatttgaagcaacgggaagaaccttaccagggcttgacatatgggtgaagcgggggagaccccgtggccgagaggagcccatacagagtggtgcatggctgtcgtcagctcgtgtcgtgagatgttgagttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccacccccatgaagtcggagttgctagtaatcgcggatcagcatgccgcggtgaatgcgttcccgggccttgcacacacagcccgtca

SEQ ID NO: 59 - DNA, 1396 bp, Artificial Sequence
  Synthetic Polynucleotide
ttcgcccttagagtttgatcctggctcaggacgaacgctggcggcgtgcctaacacatgcaagtcgagcggagaacagggaagtgcttgcacggaactgtttttagcggcggacgggtgagtaacgcgtgaacaagctgtccttcacagggggataacacttggaaacaggtgctaataccgcataagaccacaggggtgcatgctccaggggtcaaaggagcaatccggtgaagggtgcgttcgcgtcccattagatagttggcggggcaacggcccaccaagtcgacgatgggtagccgacctgagagggtgatcggccacactgggactgagacacggcccagactcctacgggaggcagcagtggggaatattgggcaatgggcgaaagccttacccagcaacgccgcgtgagggaagaaggttttcggattgtaaacctctgtcctgggggacgaaggaagtgacggtaccccgggaggaagccccggctaactacgtgccagcagccgcggtaatacgtagggggcgagcgttgtccggaattattgggcgtaaagggcgcgtagacggctgagtaagttactggtgaaagcccggcttttaaggctggaattgccggtaatactgttcagcttgagtgcaggagagggaagcggaattcctagtgtagcggtgaaatgcgtagatattaggaggaacaccagtggcgaaggcggctttctggactgtaactgacgttgaggcgcgaaagcgtggggagcaaacaggattagataccctggtagtccacgccgtaaacgatggatgctaggtgtgggaggtatcgaccccttccgtgccgcagttaacgcaataagcatcccgcctggggagtacggccgcaaggttgaaactcaaaggaattgacgggggcccgcacaagcagcggagcatgtggtttaattcgacgcaacgcgaagaaccttaccaggtcttgacatccacttaaacttacagagatgtaaggtgtgcttgcacaaagtgagacaggtggtgcatggttgtcgtcagctcgtgtcgtgagatgttgggttaagtcccgcaacgagcgcaacccttatcttcagttactaacgcgtagaggtgaggactctgaagagactgccggggacaactcggaggaaggtggggacgacgtcaaatcatcatgccccttatgacctgggctacacacgtgctacaatggccacgacagagagaagcgaaatcgcaaggtagagcggaactcaaaaaagtggtcccagttcggattgtgggctgcaacccgcccacatgaagtcggagttgctagtaatcgcggatcagcatgccgcggtgaatacgttcccgggccttgtacacaccgcccgtca

SEQ ID NO: 60 - DNA, 1385 bp, Artificial Sequence
  Synthetic Polynucleotide
ttcgcccttagagtttgatcctggctcaggacgaacgctggcggcgcgcctaacacatgcaagtcgaacgagcgagagagagcttgctttctcaagcgagtggcggacgggtgagtaacgcgtgagcaacctggcctatacagggggataacagggagaaattcctgctaataccgcataagaccacagtatcgcatggtactggggtcaagggagagattcggtataggatgggctcgcgtcccattagctagttgggggtgcaacggaccaccaaggcgacgatgggtagccgacctgagagggtgatcggccacactgggactgagacacggcccagactcctacgggaggcagcagtagggaatattggacaatgggggaaaccctgatccagcaacgccgcgtgaaggaagaaggtcttcggattgtaaacttatgttgtcggggacgaagaaagacggtacccgacgaggaagccccggctaactacgtgccagcagccgcggtaatacgtagggggcgagcgttgtccggaattactgggcgtaaagggcgcgtaggcggccaattaagttagatgtgaaatccccgggcttaacctgggtgttgcatttaaaactgataggcttgagtgcaggagagggaagcggaattcctagtgtagcggtggaatgcgtagatattaggaggaacaccagtggcgaaggcggctttctggactgtaactgacgctgaggcgcgagagcgtggggagcaaacaggattagataccctggtagtccacgccgtaaacgatggatactaggtgtagagggtatcgaccccctctgtgccggagcaaacgcaataagtatcccgcctggggagtacggccgcaaggttgaaactcaaaggaattgacgggggcccgcacaagcagcggagcatgtggtttaattcgaagcaacgcgaagaaccttaccaaggcttgacatcccctgacgtatgtagagatacatatttccttcgggacagggagacaggtggtgcatggttgtcgtcagctcgtgtcgtgagatgttgggttaagtcccgcaacgagcgcaacccttgtatacagttaccagtattaagttagggactctgtatagactgccgtggataacacggaggaaggtggggacgacgtcaaatcatcatgccccttatgtcttgggctacacacgtgctacaatggccgcaacagagggcagcgaagtggcaacatggagcgaatctcaaaaaagcggtctcagttcagattgtgggctgcaacccgcccacatgaagacggagttgctagtaatcgcggatcagcatgccgcggtgaatgcgttcccgggccttgcacacaccgcccgtca

SEQ ID NO: 61 - DNA, 1367 bp, Artificial Sequence
  Synthetic Polynucleotide
agagtttgatcctggctcaggatgaacgctggcggcgcgcctaacacatgcaagtcgaacggcacctatcttcggatagaagcgagtggcgaacggctgagtaacacgtggagaacctgccccctcccccgggatagccgcccgaaaggacgggtaataccggatacccccgggcgccgcatggcgcccgggctaaagccccgacgggaggggatggctccgcggcccatcaggtagacggcggggtgacggcccaccgtgccgacaacgggtagccgggttgagagatcgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacactaggtgtggggggacgatccccccgtgcggcagccagtgcattaatgcgtcccgccgggggagtacggccgcaaggataaaattagaaggaatttaagggggccggcacaagcatcggagcatgtggattaaatggaagcaacgcgaagaaccttatcaggccctgacatatgggtgaagcgggggagaccccgtggccgagaggagcccatacaggtggtgcatggctgtcgtcagctcgtgtcgtgagatgttgggttaagtcccgcaacgagcgcaacccccgctgtgtgttgccatcgggtgatgccgggaacccacgcgggaccgccgccgtcaaggcggaggagggcggggacgacgtcaagtcaccatgccccttatgccctgggctgcacacgtgctacaatggccggtacagagggatgccaccccgcgagggggagcggatcccggaaagccggccccagttcggaaaagggggctgcaacccgcccccatgaagtcggagttgctagtaatcgcggatcagcatgccgcggtgaatgcgatcccgggccttgcactcaccgcccgtca

SEQ ID NO: 62 - DNA, 1380 bp, Artificial Sequence
  Synthetic Polynucleotide
ttcgcccttagagtttgatcctggctcaggacgaacgctggcggcgcgcctaacacatgcaagtcgaacgagcgagagagagcttgctttctcgagcgagtggcgaacgggtgagtaacgcgtgaggaacctgcctcaaagagggggacaacagttggaaacgactgctaataccgcataagcccacaggtcggcatcgaccagagggaaaaggagcaatccgctttgagatggcctcgcgtccgattagctagttggtgaggtaatggcccaccaaggcgacgatcggtagccggactgagaggttgaacggccacattgggactgagacacggcccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggtttcttaagtcagaggtgaaaggctacggctcaaccgtagtaagcctttgaaactgggaaacttgagtgcaggagaggagagtggaattcctagtgtagcggtgaaatgcgtagatattaggaggaacaccagttgcgaaggcggctctctggactgtaactgacactgaggcacgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaacacaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgttaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgcacacaccgcccgtca

SEQ ID NO: 63 - DNA, 1386 bp, Artificial Sequence
  Synthetic Polynucleotide
agagtttgatcctggctcaggatgaacgctggcggcgtgcctaacacatgcaagtcgagcgagaagctgatgactgattcttcggatgagagattcagtggaaagcggcggacgggtgagtaacgcgtaggcaacctgccctttgcagagggatagccattggaaacgatgattaaaacctcataatacctttttcctgcataggagagaggtcaaagatttatcggcaaaggatgggcctgcgtctgattagctggttggtggggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggaggaaggccttcgggtcgtaaacttctgtccttgaggaagaagaaatgacggtactcaaggaggaagccccggctaactacgtgccagcagccgcggtaatacgtagggggcaagcgttatccggaattattgggcgtaaagagtgcgtaggtggttacctaagcgcagggtataaggcaatggctcaaccattgttggccctgcgaactgggctacttgagtgcaggagaggaaagcggaattcctagtgtagcggtgaaatgcgtagatattaggaggaacaccagtggcgaaggcggctttctggactgtaactgacactgaggcacgaaagcgtggggagcaaacaggattagataccctggtagtccacgccgtaaacgatgagcattaggtgtcggggccgcaaggcttcggtgccgcagtcaacgcattaagtgctccgcctggggagtacgcaagcaagtgtgaaactcaaaggaattgacggggacccgcacaagcagcggagcatgtggtttaattcgaagcaacgcgaagaaccttaccaggacttgacatccctctgacaggaccttaaccggttccttctacggacagaggagacaggtagtgcatggttgtcgtcagctcgtgtcgtgagatgttgggttaagtcccgcaacgagcgcaacccttgccattagttgccagcagtaagatgggcactctaatgggaccgccggggacaactcggaggaaggtggggatgacgtcaaatcatcatgccccttatgttctgggctacacacgtgctacaatggccggtacagaaagtcgcgaagccgcgaggcggagccaatctcgaaaaccggtcccagttcggactgcaggctgaaacccgcaatgcacgaagtcggagttgctagtaatcgcggatcagcatgccgcggtgaatgcgttcccgggtcttgcacaaagcgcccgtca

SEQ ID NO: 64 - DNA, 1402 bp, Artificial Sequence
  Synthetic Polynucleotide
agagtttgatcctggctcaggatgaacgctagcgacaggcctaacacatgcaagtcgaggggcagcggggaggtagcaatacctttgccggcgaccggcgcacgggtgagtaacacgtatgcaatccacctgtaacagggggataacccggagaaatccggactaataccccataatatgggcgctccgcatggagagtccattaaagagagcaatcttggttacagacgagcatgcgctccattagccagttggcggggtaacggcccaccaaggcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtgcgctacgcgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaatttccgggctcaatccggactgtgccgttgaaactggcgagctagagtgcacaagaggcaggcggaatgcgtggtgtagcggtgaaatgcatagatatcacgcagaaccccgattgcgaaaggcagcctgccaagccattactgacgctgatgcacgaaagcgtgggggatcaaccaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtca

SEQ ID NO: 65 - DNA, 1389 bp, Artificial Sequence
  Synthetic Polynucleotide
ttcgcccttagagtttgatcctggctcaggacgaacgctggcggcgtgcctaacacatgcaagtcgaacggagatatttatttcggtagatatcttagtggcgcacgggtgagtaacgcgtgaataacctgacccgaagagggggataacacctggaaacaagtgctaataccgcataagaccacggaccggcatcggtcagaggtcaaaggaggaatccgctttgggaggggttcgcgtcccattaggtagttggtgaggtaacggcccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcaggggacgaaggaagtgacggtaccctgtaagaaagccccggctaactacgtgccagcagccgcggtaatacgtagggggcgagcgttgtccggaattactgggcgtaaagggagcgtaggcggtcgattaagttagatgtgaaacccccgggcttaacttggggactgcatctaatactggttgacttagagtacaggagagggaagcggaattcctagtgtagcggtgaaatgcgtagatattaggaggaacaccagtggcgaaggcggctttctggaccgacactgacgctgaggctcgaaagcgtggggagcaaacaggattagataccctggtagtccacgctgtaaacgatgaatactaggtgtagggggtatcaactccctctgtgccgcagcaaacgcaataagtattccgcctggggagtacggccgcaaggttgaaactcaaaggaattgacgggggcccgcacaagcagcggagcatgtggtttaattcgaagcaacgcgaagaaccttaccaagtcttgacatctccctgacagagtatgtaatgtacttttccttcgggacagggaagacaggtggtgcatggttgtcgtcagctcgtgtcgtgagatgttgggttaagtcccgcaacgagcgcaacccttatcctcagtagccagcggttcggccgggcactctgtggagactgccagggataacctggaggaaggtggggatgacgtcaaatcatcatgccccttatgacttgggctacacacgtgctacaatggcgtaaacaaagggaagcaagagagcgatctggagcaaatcccaaaaataacgtcccagttcggattgtagtctgcaactcgactacatgaagctggaatcgctagtaatcgcgaatcagaatgtcgcggtgaatacgttcccgggtcttgtacacaccgcccgtca

SEQ ID NO: 66 - DNA, 1351 bp, Artificial Sequence
  Synthetic Polynucleotide
agagtttgatcctggctcaggatgaattttggcggcgtgcctaacacatgcaagtcgaacgatgaaaccgccctcgggcggacatgaagtggcgaacgggtgagtaacacgtgaccaacctgccccttgctccgggacaaccttgggaaaccgaggctaataccggatactcctcgcccccctcctggggggcccgggaaagcccagacggcaagggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggaaaccctgacgcagcaacgccgcgtgcgggacgacggccttcgggttgtaaaccgctttcagcagggaagaaattcgacggtacctgcagaagaagctccggctaactacgtgccagcagccgcggtaatacgtagggagcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaaactcaaaggaattgacgggggcccgcacaagcagcggagcatgtggcttaattcgaagcaacgcgaagaaccttaccagggcttgacatatgggtgaagcgggggagaccccgtggccgagagggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggc

SEQ ID NO: 67 - DNA, 1392 bp, Artificial Sequence
  Synthetic Polynucleotide
agagtttgatcctggctcaggatgaacgctggcggcgtgcttaacacatgcaagtcgaacgaagcatttgcaacagatttcttcggattgaagttgcttatgactgagtggcggacgggtgagtaacgcgtgggtaacctgcctcatacagggggatagcagctggaaacggctggtaataccgcataagcgcacagtaccacatggtacagtgtgaaaaactccggtggtatgagatggacccgcgtctgattagctagttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaaatggaattcctagtgtagcggtgaaatgcgtagatattaggaggaacaccagtggcgaaggcggcttgctggactgtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgttccttaaccggaactttccttcgggacaggggagacaggtggtgcatggttgtcgtcagctcgtgtcgtgagatgttgggttaagtcccgcaacgagcgcaacccctatccccagtagccagcggttcggccgggcactctgaggagactgccagggataacctggaggaaggcggggatgacgtcaaatcatcatgccccttatgatttgggctacacacgtgctacaatggcgtaaacaaagagaagcgaactcgcgagggtaagcaaatctcaaaaataacgtctcagttcggattgtagtctgcaactcgactacatgaagctggaatcgctagtaatcgcagatcagaatgctgcggtgaatacgttcccgggtcttgtacacaccgcccgtca

SEQ ID NO: 68 - DNA, 1395 bp, Artificial Sequence
  Synthetic Polynucleotide
agagtttgatcctggctcaggatgaacgctagcggcaggcttaacacatgcaagtcgaggggcagcataatggtagtaatactattgatggcgaccggcggacgggtgcgtaacgcgtatgcaacctaccctttacagggggataacactgagaaatcggtactaataccccataatattctgggaggcatctttcggagttgaaagctttggtggtaaaggatgggcatgcgttgtattagctagttggtaaggtaacggcttaccaaggcgacgatacatagggggactgagaggttaaccccccacattggtactgagacacggtccaaactcctacgggaggcagcagtgaggaatattggtcaatggtcggcagactgaaccagccaagtcgcgtgagggaagacggccctacgggttgtaaacctcttttgtcggagagtaaagtacgctacgtgtagcgtattgcaagtatccgaagaaaaagcatcggctaactccgtgccagcagccgcggtaatacggaggatgcgagcgttatccggatttattgggtttaaagggtgcgtaggcggcacgccgagtcagcggtgaaatttccgggctcaacccggagtgtgccgttgaaactggcgagctagagtacacaagaggcaggcggaatgcgtggtgtagcggtgaaatgcatagatatcacgcagaaccccgattgcgaaggcagcctgctagggtgaaacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatgtcggtgaaagccggcagctagtaatagtcacctgcgaggtgctgcatggttgtcgtcagctcgtgccgtgaggtgtcggcttaagtgccataacgagcgcaacccctatcgacagttactaacgggtgaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgtactcaccgcccgtca

SEQ ID NO: 69 - DNA, 1386 bp, Artificial Sequence
  Synthetic Polynucleotide
agagtttgatcctggctcaggatgaacgctggcggcgtgcctaacacatgcaagtcgagcgagaagctcatgacggaaacttcggttgacggattgagtggaaagcggcggacgggtgagtaacgcgtaggcaacctgccccttacagagggatagccattggaaacgatgattaaaacctcataacgcaaggcagtcacatgacagttttgccaaagatttatcggtaagggatgggcctgcgtctgattagctggttggtggggtaacggcctaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggaagaaggccttcgggtcgtaaacttctgtcctaggggaagaagaaaatgacggtacccttggaggaagccccggctaactacgtgccagcagccgcggtaatacgtagggggcgagcgttatccggaattattgggcgtaaagagtgcgtaggtggctttctaagcgcagggtttaaggcaatggcccaaccattgttcgccctgcgaactgggaggcttgagtgcaggagaggaaagcggaattcctagtgtagcggtgaaatgcgtagatattaggaggaacaccagtggcgaaggcggctttctggactgtaactgacactgaggcacgaaagtgtgaggagcaaacaggattagataccctggtagtccacaccgtaaacgatgagcactaggtgtcggggtcgcaagacttcggtgccggagttaacgcattaagtgctccgcctggggagtacgtacgcaagtatgaaactcaaaggaattgacggggacccgcacaagcagcggagcatgtggtttaattcgaagcaacgcgaagaaccttaccaggacttgacatcctcctgacagatctttaatcggattcttctacggacaggagagacaggtggtgcatggttgtcgtcagctcgtgtcgtgagatgttgggttaagtcccgcaacgagcgcaacccttgccattagttgccagcagtaagatgggcactctaatgggactgccggggacaactcggaggaaggtggggatgacgtcaaatcatcatgccccttatgttctgggctacacacgtgctacaatggccggtacagaaagcagcgaagccgcgaggcggagcaaatctcgaaaaccggtcccagttcggactgcaggctgcaacccgcctgcacgaagccggagttgctagtaatcgcgaatcagaatgtcgcggtgaatgcgttcccgggtcttgcactcaccgcccgtca

SEQ ID NO: 70 - DNA, 1339 bp, Artificial Sequence
  Synthetic Polynucleotide
tggcggcgcgcctaacacatgcaagtcgaacggcacctatcttcggatagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacgggattagataccctggtagtcccagccgtaaaccatgaacggtaggtgtggggggtcgatcctcccgttccgcagccaaggcattaagcgtcctgacgccggggagtagggccgcaaggctaaaactcaaaaagaattgtcggggtcccgcgcaagcagcggagcatgtggtttaattggaagcaagacgaagaaccttcctgtggtttgacatatgggtgatgcgggggaggggggggggcaaaaaaaagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtactcaccgcccgtca

SEQ ID NO: 71 - DNA, 1381 bp, Artificial Sequence
  Synthetic Polynucleotide
ttcgcccttagagtttgatcctggctcaggacgaacgctggcggcgtgcttaatacatgcaagtcgaacggagttaagggtttcggcctttaacttagtggcgaacgggtgagtaacgcgtgaataacctgactcaaagagggggataacaacgggaaactgttgctaataccgcatgagaccacaacaccgcatgatgaaggggtcaaagatttatcgctttgagaggggttcgcgtcccattaggtagttggaggggtaacggcccaccaagccaacgatgggtagccgagctgagaggctgatcggccacactggaactgagacacggtccagactcctacgggaggcagcagtagggaatattgggcaatgggcgcaagcctgacccagcaacaccgcgtgagggaagaaggttttcggattgtaaacctctgtcctatgtgacgaaggaagtgacggtagcataggaggaagccccggctaactacgtgccagcagccgcggtaatacgtagggggcgagcgttgtccggaattactgggcgtaaagggtgcgtaggcggtttggtaagttggatgtgaaatacccgggcttaacttgggggctgcatccaatactgtcggacttgagtgcaggagaggagagcggaattcctagtgtagcggtgaaatgcgtagatattcggaggaacaccagtggcgaaggcggcctgctgggctttaactgacgctgaggctcgaaagtgtggggagcaaacaggattagataccctggtagtccacactgtaaacgatgattgctaggtgtggggggtctgaccccttccgcgccggagttaacgcaataagcaatccacctggggagtacggccgcaaggttgaaactcaaaggaattgacgggggcccgcacaagcagtggattatgtggtttaattcgacgcaacgcgaagaaccttaccaggtcttgacatccaacgaatccttaagagattagggagtgcctttcggggaacgttgagacaggtggtgcatggttgtcgtcagctcgtgtcgtgagatgttgggttaagtcccgcaacgagcgcaacccctgccattagttgctacgcaagagcactctaatgggaccgctaccgacaaggtggaggaaggtggggacgacgtcaaatcatcatgccccttatgacctgggctacacacgtaatacaatggccgttaacaacgggaggcaaaaccgcgaggtagagcaaaaccctaaaaacggtcccagttcggatcgcaggctgcaacccgcctgcgtgaagttggaattgctagtaatcgcggatcagcatgccgcggtgaatacgttcccgggccttgcacacaccgcccgtca

SEQ ID NO: 72 - DNA, 1401 bp, Artificial Sequence
  Synthetic Polynucleotide
agagtttgatcctggctcaggatgaacgctagctacaggcttaacacatgcaagtcaaggggcagcatggtcttagcttgctaagaccgatggcgaccggcgcacgggtgagtaacacgtatccaacctgccttatactcccgaacagccttctgaaaggaagattaatacgggatggtatcacgggccagcattttctcgtgattaaagaatttcggtataagatggggatgcgttccattagatagtaggcggggtaacggcccacctagtctacgatgtctaggggttctgagaggaaggtcccccacactggtactgagacacggaccagactcctacgggaggcagcagtgaggaatattggtcaatggtcgggagactgaaccagccaagccgcgtgagggaggaaggtacagagtatcgtaaacctcttttgtcagggaacaaaggcggggacgtgtccccggatgagtgtacctgaagaaaaagcatcggctaactccgtgccagcagccgcggtaatacggaggatgcgagcgttatccggatttattgggtttaaagggtgcgcaggcggtctgttaagtcagcggtcaaagcccggggctcaaccccggcccgccgttgaaactggcagtctcgagttggagagaagtatgcggaatgcgcggtgtagcggtgaaatgcatagatatcgcgcagaactccgattgcgaaggcagcatgccggctccacactgacgctgaggcacgaaagcgtgggtatcgaacaggattagataccctggtagtccacgcagtaaacgatgaatgctggctgtccggggggactgacccctgggcggcgaagcgaaagcgaataagcattccacctggggagtacgccggcaacggtgaaactcaaaggaattgacgggggcccgcacaagcggaggaacatgtggtttaattcgatgatacgcgaggaaccttacccgggctcaaacggggagtggcgcaggcagagacgcctgtttcccacgggacactccccgaggtgctgcatggttgtcgtcagctcgtgccgtgaggtgtcggcttaagtgccataacgagcgcaacccccgcgtgcagttgctaacagtcaacgctgaggactctgcgcggactgccggcgcaagccgcgaggaaggcggggatgacgtcaaatcagcacggcccttacgtccggggcgacacacgtgttacaatgggtggtacagcgggaagccaggcggcgacgccgagcggaacccgaaatccactctcagttcggatcggagtctgcaacccgactccgtgaagctggattcgctagtaatcgcgcatcagccatggcgcggtgaatacgttcccgggccttgcacacaccgcccgtca

SEQ ID NO: 73 - DNA, 1391 bp, Artificial Sequence
  Synthetic Polynucleotide
agagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgcctcatacagggggataacagttagaaatgactgctaataccgcataagaccacagcaccgcatggtgcaggggtaaaaactccggtggtgtgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcagcagggaagacagtgacggtacctgactaagaagctccggctaaatacgtgccagcagccgcggtaatacgtatggagcaagcgttatccggatttactgggtgtaaagggagtgtaggtggtatcacaagtcagaagtgaaagcccggggctcaaccccgggactgcttttgaaactgtggaactggagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccttctgaccggacagtaatgtgtcctttccttcgggacagaagagacaggtggtgcatggttgtcgtcagctcgtgtcgtgagatgttgggttaagtcccgcaacgagcgcaacccctatcctcagtagccagcaggtaaagctgggcactctgtggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacaaagccgggtcttgcacacaccgcccgtca

SEQ ID NO: 74 - DNA, 1371 bp, Artificial Sequence
  Synthetic Polynucleotide
agagtttgatcctgtgtctcaggatgaacgctggcggcgtgcctaacacatgcaagtcgaacggttaaggcgccctcgggcgcgcatagagtggcgaacgggtgagtaacacgtgaccaacctgccccctcctccgggacaacctcgggaaaccgaggctaataccggatgcccccgccgggccgcatggccgggcggggaaagcccagacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgcactcaccgcccgtca

SEQ ID NO: 75 - DNA, 1384 bp, Artificial Sequence
  Synthetic Polynucleotide
agagtttgatcctggctcaggatgaacgctggcggcgcgcctaacacatgccaggttgttacgagcgagatgaggacctttctttttcaagggagtggcgaacggggcgagtaacgcgggggtaacctgcctccatgcagggggataaccaatcggaaatcggcttgctaataccggcataagccgctcagtaccgccatggtcgccccggctaaagccccgacgggaggggatggctccgcggcccatcaggtagacggcggggtgacggcccaccgtgccgacaacgggtagccgggttgagagaccgaccggccagattgggactgagacacggcccagattcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgagccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgcacacaccgcccgtca

SEQ ID NO: 76 - DNA, 1415 bp, Artificial Sequence
  Synthetic Polynucleotide
agagtttgatcctggctcaggatgaacgctagcgacaggcttaacacatgcaagtcgaggggcagcggaggcgagtgcttgcacttgccagacggcgaccggcgcacgggtgagtaacacgtatgcgacctgcccgtagcagggggataagcggaagaaattccgtctaataccgcgtaatatctttcgggggcatccctgagggattaaaggaagcgattccggctacggatgggcatgcggcgcattagctagttggcggggcaacggcccaccaaggcgacgatgtctaggggttctgagaggaaggtcccccacactggtactgagacacggaccagactcctacgggaggcagcagtgaggaatattggtcaatgggcgcgagcctgaaccagccaagtcgcgtgagggatgacggccctacgggttgtaaacctcttttgtcggggagcaaattccgccacgcgtggcggagtcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaacgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatactagctgtccggggcgaatgagccctggggtggcacagcgaaagcgttaagtattcctcctggggagtacgcccggcaagggtgaaagtcaaaagaattgaccggggggcccgcacaaacgggaggaacatgtggtctaattcgatgatacgcgaggaacctcacccgagctcaaacgacacaaggaacgtacatgaaagggttcggctgtacggagcatgtgtgcgaggcgctgcatggtagtcgtcagctcgtgccgtgaggtgtggggttaagtgccataacgagcgcaacccccatcgacagttgataacaggtcaggatgaggactctgtcgagacgtccggcgcaagctgcgaggaaggcgggggtgacgtcaaatcagcacggcccttacgtccggggcgacacacgtgttacaatggcaggtacagcgggaagccaccgggcgtcagggagcggaacccgaaagcctgtctcagttcggatgggagtctgcaccccgactccatgaagctggattagctagtaatcgtgcatcagccacggcgcggtgaataagttcccgggcctggcacacaccgcccgtca

SEQ ID NO: 77 - DNA, 1390 bp, Artificial Sequence
  Synthetic Polynucleotide
agagtttgatcctggctcaggatgaacgctggcggcgtgcttaacacatgcaagtcgagcgaagcacttaagtttgattcttcggatgaagacttttgtgactgagcggcggacgggtgagtaacgcgtgggtaacctgcctcatacagggggataacagttagaaatggctgctaataccgcataagaccacagtactgcatggtacagtggtaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcgtgtaatgacgccttttcttcggaacaccggtgacaggtggtgcatggttgtcgtcagctcgtgtcgtgagatgttgggttaagtcccgcaacgagcgcaacccttatcttcagtagccagcattttggatgggcactctggagagactgccagggataacctggaggaaggtggggatgacgtcaaatcatcatgccccttatgagcagggctacacacgtgctacaatggcgtaaacaaagggaagcaaacctgcgagggtaagcaaatctcaaaaataacgtctcagttcggattgtagtctgcaactcgactacatgaagctggaatcgctagtaatcgcgaatcagcatgtcgcggtgaatacgttcccgggtcgtgcactcaccgcccgtca

SEQ ID NO: 78 - DNA, 1407 bp, Artificial Sequence
  Synthetic Polynucleotide
agagtttgatcctggctcaggatgaacgctggcggcgtgcttaacacatgcaagtcgagcgaagcgctttggaaagattcttcggatgatttcctttgtgactgagcggcgcacgggtgagtaatacatcggaacgtgtcctgttgtgggggataactgctcgaaagggtggctaataccgcatgagacctgagggtgaaagcgggggatcgcaagacctcgcgcaattggagcggccgatgcccgattagctagttggtgaggtaaaggctcaccaaggcgacgatcggtagctggtctgagaggacgaccagccacactgggactgagacacggcccagactcctacgggaggcagcagtggggaattttgggcaatgggggcaaccctgatccagccatgccgcgtgcaggatgaaggccttcgggttgtaaactgcttttgtcagggacgaaaaggaccgtgttaataccatggtctgctgacggtacctgaagaataagcaccggctaactacgtgccagcagccgcggtaatacgtagggtgcaagcgttaatcggaattactgggcgtaaagcgtgcgcaggcggttctgtaagacagatgtgaaatccccgggctcaacctgggaattgcatttgtgactgcaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacaggattagataccctggtagtccacgccctaaacgatgtctactggttgttggggtttattaaccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaatcctgaagagattcgggagtgcccgcaagggaatctggacacaggtgctgcatggctgtcgtcagctcgtgtcgtgagatgttgggttaagtcccgcaacgagcgcaacccttgtcactagttgctacgcaagagcactctagtgagactgccggtgacaaaccggaggaaggtggggatgacgtcaagtcctcatggccctcatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgcactcaccgcccgtca

SEQ ID NO: 79 - DNA, 1411 bp, Artificial Sequence
  Synthetic Polynucleotide
agagtttgatcctggctcaggatgaacgctagcgacaggcttaacacatgcaagtcgaggggcagcggggcaagaagcttgctttctgccgccggacaccggcgcacgggagagtaacacatatgccacctgcccgtgacagatagataaccaggaaaaatcccccctaatacagcatgaccccgggaagggacatccctttccggccaaagggggcgactccggacacggatgggcatgcggcgcattaggtagttggtggggcaacggcccaccaagacgactatgcgtaggggttttgagaggaaggttccccacattggatctgagacacggtccaaactccttcgggaggcagcagtgaggaatattggtcaatggccggaaggctgaaccagccaagttgggtgagggaataaggccctacgggttgtaaaccttttttgccagggagcaatgccgtccacgtgtggacggaaggagagtacctggagaaaaagcatcggctaactccgtgccagcagccgcggtaatacggaggatgcgagcgttatccggatttattgggtttaaagggtgcgtaggcggcctgccaagtcagcggtaaaattgcggggctcaaccccgtccagccgttgaaactgccgggctagagtgggcgagaagtatgcggaatgcgtggtgtagcggtgaaatgcatagatatcacgcagaaccccgattgcgaaggcagcataccggcgcccgactgacgctgaggcacgaaagtgcggggatcaaacaggattagataccctggtagtccgcacagtaaacgatgaatgttagctgtccgggtggatttacccctgggtggcacaacgaaagggtttaagcattccccctggggagtacgccggcaacggtgaaactcaaaggaattgacgggggcccgcacaagcggaggaacatgtggtttaatttgatgatacgggaggaaccttacccgagctcaaacgcggaagggacattctctgaaaggagataggccagcaatggtcttgggggaggtgcggcatggttgtgttcagctcgtgccgtgaggtgtcggcttaagtgccataacgagcgcaaccccctccgccagttgctaaatggtcaagcagaggattctgtcgggactgccggcccaagctgggaggaagggggggatgacgtcaaatcagcacggcccttacgtcgggggggacacacgtgttacaatggcaggtacaacgggatgccctggggcgccccagaggggaacccgaaaacctgtctcagttcggattggagtctgcaacccgactccatgaagctggattcgctagtaatcgcgcatcagccacggcgcggtgaatacgttcccgggccttgcacacacagcccgtca

SEQ ID NO: 80 - DNA, 1385 bp, Artificial Sequence
  Synthetic Polynucleotide
agagtttgatcctggctcaggatgaacgctggcggcgtgcctaacacatgcaagtcgaacgggaaaccttttattgaagcttcggcagatttagattgtttctagtggcggacgggtgagtaacgcgtgggtaacctgccttatacagggggataacagtcagaagtgactgctaataccgcataagcgcacagagctgcatggctcagtgtgaaaaactccggtggtataagatggacccgcgttggattagctggttggtgaggtaacggcccaccaaaccgacgatcagtaaccgacctgagagggtgatcggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgcccggtcagtaatgtggccttttcttcggaacaagagtgacaggtggtgcatggttgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgtggatcagcatgccacggtgaatacgttcccgggccttgcactcaccgcccgtca

SEQ ID NO: 81 - DNA, 1385 bp, Artificial Sequence
  Synthetic Polynucleotide
agagtttgatcctggctcaggatgaacgctggcggcgtgcttaacacatgcaagtcgaacgaagcactttaccacgattccttcgggatgacggtttagtgactgagtggcggacgggtgagtaacgcgtggggaacctgccccataccgggggataacagccggaaacggctgctaataccgcataagcgcacagtaccgcatggtacggtgtgaaaaactccggtggtatgggatggacccgcgtctgattagccagttggcggggtaacggcccaccaaagcgacgatcagtagccggcctgagagggcgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcctgctggactgttactgacactgaggcacgaaagcgtggggagcaaacaggattagataccctggtagtccacgctgtaaacgatgaatactaggtgtcggggccgtataggcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccactccgtaatgggagctttccttcgggacagaagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacatcaaatcatcatgccccttatgtcctgggctacacacgtaatacaatggcggtcaacagagggatgcgataccgcaaggtggagcgaacccttaaaagccgtcccagttcagattgtgggctgcaacccgcccacatgaagtcggaatcgctagtaatcgcagatcagcatgctgcggtgaatacgttcccgggccttgcactcaccgcccgtca

SEQ ID NO: 82 - DNA, 1392 bp, Artificial Sequence
  Synthetic Polynucleotide
agagtttgacctggctcaggatgaacgctggcggcgtgcttaacacatgcaagtcgaacgaagcaccttggacagattcttcggatgaagtccttagtgactgagtggcggacgggtgagtaacgcgtgggtaacctgcctcatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaagcccggggctcaaccccgggactgcttttgaaactgtggaactggagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcgggggctcataagagcttcggtgccgcagcaaacgcaataagtattccgcctggggagtacgttcgcaagaatgaaactcaaaggaattgacggggacccgcacaagcggtggagcatgtggtttaattcgaagcaacgcgaagaaccttaccaagtcttgacatccttctgaccggacagtaatgtgtcctttccttcgggacagaagagacaggtggtgcatggttgtcgtcagctcgtgtcgtgagatgttgggttaagtcccgcaacgagcgcaacccctatcctcagtagccagcaggtaaagctgggcactctgtggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtcttgcactcaccgcccgtca

SEQ ID NO: 83 - DNA, 1402 bp, Artificial Sequence
  Synthetic Polynucleotide
agagtttgatcctggctcaggatgaattctagcgacaggcttaacacatgcaagtcgaggggcagcgcggtggtggcaacaccaccggcggcgaccggcgcacgggtgagtaacacgtatgcaacctgccctccacagggggataatcgggagaaatcccgtctaataccgcataacgccaaccgggggcatccccggttggccaaaggagcgatccggtgggggctgggcatgcgccgcattagccagttggcggggtaacggcccaccaaggcgacgattcgtaggggttctgagaggaaggtcccccacactggtactgagacacggaccagactcctacgggaggcagcagtgaggaatattggtcaatgggcggaagcctgaaccagccaagtcgcgtgagggaagacggtcctatggattgtaaacctcttttgtcggggagcaaggggcgccacgagtggcgtcaagcgagagtacccgaagaaaaagcatcggctaactccgtgccagcagccgcggtaatacggaggatgcgagcgttatccggatttattgggtttaaagggtgcgtaggcggcacgccaagtcagcggtgaaatttccgggctcaacccggagtgtgccgttgaaactggcgagctagagtacacaagaggcaggcggaatgcgtggtgtagcggtgaaatgcatagatatcacgcagaaccccgattgcgaaggcagcctgctagggtgaaacagacgctgaggcacgaaagcgtgggtatcgaacaggattagataccctggtagtccacgcagtaaacgatgaatactaactggtttgcgatacaatgtaagcggtacagcgaaagcgttaagtattccacctggggagtacgccgggcaacggtgaaactcaaaggaattgacgggggcccgcacaagcggaggaacatgtggtttaattcgatgatacgcgaggaaccttacccgggctcaaacgacgcaggaatgtttttgaaaggaggcagcccttcggggcctgcgtcgaggtgctgcatggttgtcgtcagctcgtgccgtgaggtgtcggcttaagtgccataacgagcgcaacccccattgacagttgctaacaggtaaagctgaggactctgtcgagactgccggcgcaagctgtgaggaaggcggggatgacgtcaaatcagcacggcccttacgtccggggcgacacacgtgttacaatggcaggtacagcgggaggccacctggcgacagggagcggaacccgaaagcctgtctcagttcggattggagtctgcaacccgactccatgaagctggattcgctagtaatcgcgcatcagccacggcgcggtgaatacgttcccgggccttgcacacaccgcccgtca

SEQ ID NO: 84 - DNA, 1394 bp, Artificial Sequence
  Synthetic Polynucleotide
agagtttgatcctggctcaggatgaacgctggcggcgtgcttaacacatgcaagtcgaacgaagcatttaagacggattttttcggaatgaagttttttatgactgagtggcggacgggtgagtaacgcgtgggtaacctgcctcacacagggggatagcagttggaaacgactggtaataccgcataagcgcacagcttcgcatgaagcggtgtgaaaaactccggtggtgtgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcagcagggaagacagtgacggtacctgactaagaagctccggctaaatacgtgccagcagccgcggtaatacgtatggagcaagcgttatccggatttactgggtgtaaagggagtgtaggtggtatcacaagtcagaagtgaaagcccggggctcaaccccgggactgcttttgaaactgtggaactggagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacgggggcccgcacaagcagcagagcatgtggtttaattcgaagcaacgcgaagaaccttaccaggtcttgacatccaggtaaaactgaagagattcagcgtggacttcggtccgatctgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacatcccagttcggactgtagtctgcaacccgactacacgaagctggaatcgctagtaatcgcggatcagaatgccgcggtgaatacgttcccgggtcttgcacacaccgcccgtca

SEQ ID NO: 85 - DNA, 1350 bp, Artificial Sequence
  Synthetic Polynucleotide
agagtttgatcctggctcaggacgaacgctggcggcgtgcctaacacatgcaagtcgagcgagtgaatctccttcgggagtgaagctagcggcggacgggtgagtaacacgtgggcaacctgcctcatagaggggaatagcctttcgaaaggaagattaataccgcataagattgtagcttcgcatgaagtagcaattaaaggagcaatccgctatgagatgggcccgcggcgcattagctagttggtgaggtaacggctcaccaaggcgacgatgcgtagccgacctgagagggtgatcggccacattggggctgagatacggcccagactcctacgggaggcagcagtagggaacattgggcaatgggcgcaagcctgacccagcaacgccgcgtgagggaagaaggttttcggattgtaaacctctgtcctatgtgacgaaggaagtgacggtagcataggaggaagccccggctaactacgtgccagcagccgcggtaatacgtagggggcgagcgttgtccggaattactgggcgtaaagggtgcgtaggcggtttggtaagttggatgtgaaatacccgggcttaacttgggggctgcatccaatactgtcggacttgagtgcaggagaggaaagcggaattcctagtgtagcggtgaaatgcgtagatattaggaggaacaccggtggcgaaggcggctttctggactgtaactgacgctgaggcacgaaagcgtggggagcaaaccaggattagataccctggtagtccacgccgtaaacgatgaatacaaggtgtagggggtatagactccctctgtgcagcggcaaacgctataagtattcccccctggggggtacggccgcaaggttgaaactcaaaggaatggacggggggcccgcacaagcagcggagcatgtggtttaattcgacgcaacgcgaaaaacctttccaagacttgtcaccctactaaactcatggaaacatgaggtgacttcggtcgagtagagacaggtggtgcatggttgtcgtcagctcgtgtcgtgagatgttgggttaagtcccgcaacgagcgcaacccctgttgccggttaccagcgagtaaagtcggggactccggtgagactgccgaggacaactcggaggaaggtggggaagacgtcaaatcatcatgccccttatgacctgggctacacacgtactacaatggatgttaacagagggaagcaagacagcgatgtggagcaaacccctaaaaacattctcagttcagaatgcaggctgcaacccgcctgcatgaagatggaattgctagtaatcgcggatcagcatgccgcggtgaat

SEQ ID NO: 86 - DNA, 1393 bp, Artificial Sequence
  Synthetic Polynucleotide
agagtttgatcctggctcaggatgaacgctggcggcgtgcttaacacatgcaagtcgaacgaagcatttaagatggattctttcgggatgaagacttttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggcttaacccctggactgcactggaaactgctgtgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtcacgccgtaaacgatgaatactaggtgtcagggagcacagctcttttggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatccctctgaccgggacttaaccgtccctttctttcgtgacagaggagacaggtggtgcatggttgtcgtcagctcgtgtcgtgagatgttgggttaagtcccgcaacgagcgcaacccctatccttagtagccagcacgtaatggtgggcactctgaggagactgccagggataacctggaggaaggcggggatgacgtcaaatcatcatgccccttatgatttgggctacacacgtgctacaatggcgtaaacaaagggaagcgaacccgcgagggtgggcaaatctcaaaaataacgtcccagttcggactgcagtctgcaactcgactgcacgaagctggaattgctagtaatcgcggaccagaatgccgcggtgaatacgttcccgggtcttgtactcaccgcccgtca

SEQ ID NO: 87 - DNA, 1394 bp, Artificial Sequence
  Synthetic Polynucleotide
agagtttgatcctggctcaggatgaacgctggcggcgtgcttaatacatgcaagtcgaacgaagcaccttggacagaatccttcgggaggaagaccattgtgactgagtggcggacgggtgagtaacgcgtgggtaacctgccttgtacagggggacaacagttggaaacgactgctaataccgcataagcccacgggtcggcatcgaccagagggaaaaggagcaatccgctttgagatggcctcgcgtccgattagctagttggtgaggtaacggcccaccaaggcgacgatcggtagccggactgagaggttgaacggccacattgggactgagacacggcccagactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcagtggagcatgtggtttaattcgaagcaacgcgaagaaccttaccaagtcttgacatcccactgaccggacagtaatgtgtcctttccttcgggacagtggagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgcacacaccgcccgtca

SEQ ID NO: 88 - DNA, 1400 bp, Artificial Sequence
  Synthetic Polynucleotide
agagtttgatcctggctcaggatgaacgctagcgacaggcctaacacatgcaagtcgaggggcagcatttttgaagcttgcttcaaaagatggcgaccggcgcacgggtgagtaacgcgtatggaaccaacccgcaacagggggataacccggagaaatccggactaataccgcatggtactctttgcacagaagtgtgaagatttaaagatgcgaatcggttgcggacggtcatgcgttccattagctagttggcggggtaacggtccaccaaggcgacgatggataggggttctgagaggaaggtcccccacactggtactgagacacggaccagactcctacgggaggcagcagtgaggaatattggtcaatgggcgagagcctgaaccagccaagtcgcgtgagggaagacggccctatgggttgtaaacctcttttagatgggagtaaagtgttctacgcgtaggatattgcaagtaccatcagaataagcatcggctaattccgtgccagcagccgcggtaatacggaagatgcgagcgttatccggatttattgggtttaaagggtgcgtaggcgggtgattaagtcagcggtgaaatgcgtcagcttaactggcgaactgccattgaaactggttaccttgagtgtagcggaagtatgcggaatgcgtggtgtagcggtgaaatgcatagatatcacgcagaactccgattgcgaaggcagcttactaaaccataactgacactgaagcacgaaagcgtggggatcaaacaggattagataccctggtagtccacgcagtaaacgatgattactaggagtttgcgatacaatgtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtagtctgaccggagtggaaacactccttctagcaatagcagattacgaggtgctgcatggttgtcgtcagctcgtgccgtgaggtgtcggcttaagtgccataacgagcgcaacccttatcactagttactaacaggtgaagctgaggactctggtgagactgccagcgtaagctgtgaggaaggtggggatgacgtcaaatcagcacggcccttacatccggggcgacacacgtgttacaatggcatggacaaagggcagctacctggcgacaggatgctaatctccaaaccatgtctcagttcggatcggagtctgcaactcgactccgtgaagctggattcgctagtaatcgcgcatcagccatggcgcggtgaatacgttcccgggccttgtacacaccgcccgtca

SEQ ID NO: 89 - DNA, 1391 bp, Artificial Sequence
  Synthetic Polynucleotide
agagtttgatcctggctcaggatgaacgctggcggcgtgcttaacacatgcaagtcgaacgaagcatttgcgacagatttcttcgggatgaagttgcttatgactgagtggcggacgggtgagtaacgcgtgggtaacctgccttgtactgggggatagcagctggaaacggctggtaataccgtataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccctatgaataacgggcaatgccgttagtacttcggtacataggagacaggtggtgcatggttgtcgtcagctcgtgtcgtgagatgttgggttaagtcccgcaacgagcgcaacccttatctttagtagccagcagtaagatgggcactctagagagactgccggggataacccggaggaaggtggggatgacgtcaaatcatcatgccccttatgaccagggctacacacgtgctacaatggcgtaaacaaagagaagcgaagccgtgaggcagagcgaatctcaaaaataacgtctcagttcggattgtagtctgcaactcgactacatgaagctggaatcgctagtaatcgcagatcagaatgctgcggtgaatacgttcccgggtcttgcacacaccgcccgtca

SEQ ID NO: 90 - DNA, 1394 bp, Artificial Sequence
  Synthetic Polynucleotide
agagtttgatcctggctcaggatgaacgctggcggcgtgcttaacacatgcaagtcgaacgaagcatttaagacagattttttcggaatgaagttttttatgactgagtggcggacgggtgagtaacgcgtgggtaacctgcctcacacagggggatagcagttggaaacgactggtaataccgcataagcgcacagcttcgcatgaagcggtgtgaaaaactccggtggtgtgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcagcagggaagacagtgacggtacctgactaagaagctccggctaaatacgtgccagcagccgcggtaatacgtatggagcaagcgttatccggatttactgggtgtaaagggagtgtaggtggtatcacaagtcagaagtgaaagcccggggctcaaccccgggactgcttttgaaactgtggaactggagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcagcgcgaagaaccttaccaagtcttgacatccttctgaccggacagtaatgtgtcctttccttcgggacagaagagacaggtggtgcatggttgtcgtcagctcgtgtcgtgagatgttgggttaagtcccgcaacgagcgcaacccctatcctcagtagccagcaggtaaagctgggcactctgtggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtactcaccgcccgtca

SEQ ID NO: 91 - DNA, 1392 bp, Artificial Sequence
  Synthetic Polynucleotide
agagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgctggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaagtgtcgggtcacataagtgctccgggtgccgcagcaagctgcaataagtattccacatggggagtacgttcgcaagaatgaaactcaaaggaattgacggggacccgcacaagcggtggagcatgtggtttaatttgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagtccggctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgcacacaccgcccgtca

SEQ ID NO: 92 - DNA, 1389 bp, Artificial Sequence
  Synthetic Polynucleotide
agagtttgatcctggctcaggatgaacgctggcggcgtgcttaacacatgcaagtcgaacgggaaaccttttattgaagcttcggcagatttagctggtttctagtggcggacgggtgagtaacgcgtgggtaacctgccttgtacagggggataacagttggaaacggctgctaataccgcataagcgcacggcatcgcatgatgcagtgtgaaaaactccggtggtatgagatggacccgcgtctgattagcttgttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacgttgaggctcgaaagcgtggggagcaaacaggattagataccctggtagtccacgccgtaaacgatgaatactaggtgtcggggagcaaagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagccttgacatcccattgacagagcatgtaatgtgctttcccttcggggcagtggtgacaggtggtgcatggttgtcgtcagctcgtgtcgtgagatgttgggttaagtcccgcaacgagcgcaacccctatcttcagtagccagcggtttggccgggcactctggagagactgccagggataacctggaggaaggtggggatgacgtcaaatcatcatgccccttatggcttgggctacacacgtgctacaatggcgtaaacaaagggaagcgagcctgcgagggggagcaaatcccaaaaataacgtctcagttcggattgtagtctgcaacccgactacatgaagctggaatcgctagtaatcgcgaatcagaatgtcgcggtgaatacgttcccgggtcttgcacacaccgcccgtca

SEQ ID NO: 93 - DNA, 1398 bp, Artificial Sequence
  Synthetic Polynucleotide
agagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatgcgagcgttatccggatttattgggtttaaagggtgcgtaggcggcacgccaagtcagcggtgaaatttccgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatgtcggtgaaagccggcagctagtaatagtcacctgcgaggtgctgcatggttgtcgtcagctcgtgccgtgaggtgtcggcttaagtgccataacgagcgcaacccctatcgacagttactaacgggtgaagccgaggactctgtcgagactgccggcgcaagacgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgcactcaccgcccgtca

SEQ ID NO: 94 - DNA, 1393 bp, Artificial Sequence
  Synthetic Polynucleotide
agagtttgatcctggctcaggatgaacgctggcggcgtgcttaacacatgcaagtcgaacgaagcatttgcgacagatttcttcgggatgaagttgcttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggcacgaaagcatgggtagcaaacaggattagataccctggtagtccatgcccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcctgagaatccttaagagattagggagtgccttcgggaactcagagacaggtggtgcatggttgtcgtcagctcgtgtcgtgagatgttgggttaagtcccgcaacgagcgcaacccttatctttagtagccagcggtcaggccgggcactctagagagactgccagggataacctggaggaaggcggggatgacgtcaaatcatcatgccccttatgacttgggctacacacgtgctacaatggcgtaaacaaagggaagcgagcctgcgagggggagcaaatcccaaaaataacgtctcagttcggattgtagtctgcaactcgactacatgaagctggaatcgctagtaatcgcgaatcagaatgtcgcggtgaatacgttcccgggtcttgcacacaccgcccgtca

SEQ ID NO: 95 - DNA, 1410 bp, Artificial Sequence
  Synthetic Polynucleotide
agagtttgatcctggctcaggatgaacgctagcgacaggcttaacacatgcaagtcgaggggcagcagtgttgaaggcttgccttcaacagctggcgaccggcgcacgggtgagtaacacgtatgcaacctggccgtcacaggaggataatcggtagaaatgccgtctaatactccataatgctttgtgcgggcatccgcatgaggccaaaggaagcgattccggtgacggatgggcatgcggcgcattagctagtcggcggggtaacggcccaccgaggcgacgatgcgtaggggttctgagaggaaggtcccccacattggaactgagacacggtccaaactcctacgggaggcagcagtgaggaatattggtcaatgggcggaagcctgaaccagccaagtcgcgtgagggattaaggccctacgggtcgcaaacctcttctgtcagggagcaaatgcggggacgtgtccccgagtggagagtacctgaagaaaaagcatcggctaactccgtgccagcagccgcggtaatacggaggatgcgagcgttatccggatttattgggtttaaagggtgcgtaggcggattgttaagtcagcggtaaaattgcggtgctcaacgccgtagagccgttgaaactggcgatcttgagtgagcgagaagtaagcggaatgcgtggtgtagcggtgaaatgcatagatatcacgcagaaccccgattgcgaaggcagcttaccggcgctcaactgacgctgaggcacgaaagtgcgggtatcgaacaggattagataccctggtagtccgcacagtaaacgatggatactagctgttcgccgcgaatgagcggtgagtggcaaagcgaaagcgttaagtatcccacctggggagtacgccggcaacggtgaaactcaaaggaattgacgggggcccgcacaagcggaggaacatgtggtttaattcgatgatacgcgaggaaccttacccgggctcaaacgccgaagggacattccccgaaaggggattggccagcaatggtcttcggcgaggtgctgcatggttgtcgtcagctcgtgccgtgaggtgtcggcttaagtgccataacgagcgcaacccccaccgacagttgctaactggtcaagcagaggactctgtcgggactgccggcgcaagctgcgaggaaggcggggatgacgtcaaatcagcacggcccttacgtccggggcgacacacgtgttacaatggcaggtacagcgggatgccatggggcgacccagagcggaacccgaaaacctgtctcagttcggattggagtctgcaacccgactccatgaagctggattcgctagtaatcgcgcatcagccacggcgcggtgaatacgttcccgggccttgcacacaccgcccgtca

SEQ ID NO: 96 - DNA, 1505 bp, Artificial Sequence
  Synthetic Polynucleotide
tagagtttgatcctggctcaggatgaacgctagcgacaggcttaacacatgcaagtcgaggggcagcgggggcggaagcttgctttcgcccgccggcgaccggcgcacgggtgagtaacacgtatgcaacctggccgccacagggggataacccgcggaaacgcggcctaataccccgtgacgccaccggagggcatcctccggtggccaaaggagtgatccggtggcggatgggcatgcggcgcattagctagacggcggggtgacggcccaccgtggcgacgatgcgtaggggttctgagaggaaggccccccacactgggactgagacacggcccagactcctacgggaggcagcagtgaggaatattggtcaatgggcggaagcctgaaccagccaagtcgcgtgagggattaaggccctgcgggtcgtaaacctcttttgccggggagcagtggtccggacgtgtccgggccgggagagtacccggagaaaaagcatcggctaactccgtgccagcagccgcggtaatacggaggatgcgagcgttatccggatttattgggtttaaagggtgcgtaggcgggcatttaagccggcggtcaaatgtcggggctcaaccccggcctgccgtcggaactgggtgccttgagtgggcgagaagtatgcggaatgcgtggtgtagcggtgaaatgcatagatatcacgcagaaccccgattgcgaaggcagcataccggcgccctactgacgctgaggcacgaaagtgcgggtatcgaacaggattagataccctggtagtccgcacagtaaacgatggatgctatctgtccgggtcgaatgaggcctgggtggcacagcgaaagcgttaagcatcccacctggggagtacgccggcaacggtgaaactcaaaggaattgacgggggcccgcacaagcggaggaacatgtggtttaattcgatgatacgcgaggaaccttacccgggctcaaacgcctgacgaacagggtctgaaagggccttggccagcaatggcgtcaggcgaggtgctgcatggttgtcgtcagctcgtgccgtgaggtgtcggcttaagtgccataacgagcgcaacccccatcgacagttgctaacaggtcaggctgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtctcagttcggattggagtctgcaacccgactccatgaagctggattcgctagtaatcgcgcatcagccacggcgcggtgaatacgttcccgggccttgtacacaccgcccgtcaagccatggaagccgggggtgcctgaagtgcgctgccgcgaggagcgccctagggtaaaaccggtgactggggctaagtcgtaacaaggtaaccgta

SEQ ID NO: 97 - DNA, 1505 bp, Artificial Sequence
  Synthetic Polynucleotide
tagagtttgatcctggctcaggatgaacgctagcgacaggcttaacacatgcaagtcgaggggcagcgggggtgatggcttgccatcacctgccggcgaccggcgcacgggtgagtaacacgtatgcaacctgcccgccacagggggataagcggaagaaattccgtctaataccgcgtgacgcggcgtcggggcatcccggtgccgccaaagggattaccggtggcggatgggcatgcggcgcattagctagtcggcggggtaacggcccaccgaggcgacgatgcgtaggggttctgagaggaaggtcccccacactggtactgagacacggaccagactcctacgggaggcagcagtgaggaatattggtcaatggccggaaggctgaaccagccaagtcgcgtgagggaataaggccctacgggtcgtaaacctcttttgccagggagcaatgccgtccacgtgtggacggaaggagagtacctggagaaaaagcatcggctaactccgtgccagcagccgcggtaatacggaggatgcgagcgttatccggatttattgggtttaaagggtgcgtaggcggcctgccaagtcagcggtaaaattgcggggctcaaccccgtacagccgttgaaactgccgggctcgagtgggcgagaagtatgcggaatgcgtggtgtagcggtgaaatgcatagatatcacgcagaaccccgattgcgaaggcagcataccggcgcccgactgacgctgaggcacgaaagtgcggggatcaaacaggattagataccctggtagtccgcacagtaaacgatgaatgctagctgtccggggggattgacccctgggtggcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgccgaagggacattccccgaaaggggattggccagcaatggtcttcggcgaggtgctgcatggttgtcgtcagctcgtgccgtgaggtgtcggcttaagtgccataacgagcgcaacccccaccgacagttgctaactggtcaagcagaggactctgtcgggactgccggcgcaagctgcgaggaaggcggggatgacgtcaaatcagcacggcccttacgtccggggcgacacacgtgttacaatggcaggtacagcgggatgccatggggcgacccagagcggaacccgaaaacctgtctcagttcggattggagtctgcaacccgactccatgaagctggattcgctagtaatcgcgcatcagccacggcgcggtgaatacgttcccgggccttgtacacaccgcccgtcaagccatgggagccgggggtgcctgaaggccgtgaccgcgaggagcggcctagggtaaaactggtgactggggctaagtcgtaatcaaggtagccgta

SEQ ID NO: 98 - DNA, 1479 bp, Artificial Sequence
  Synthetic Polynucleotide
gagagtttgatcctggctcaggatgaacgctggcggcgtgcctaacacatgcaagtcgagcgagaagctcttgacggattcttcggatgacggagagagtggaaagcggcggacgggtgagtaacgcgtgggcaacctgcctctcacagagggatagccattggaaacgatgattaaaacctcataacactgcattttcacatggagaagcagtcaaagatttatcggtgagagatgggcccgcgtctgattagctggttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggaagaaggccttcgggtcgtaaacttctgtccaaggggaagaagaactgacggtacccaaggaggaagccccggctaactacgtgccagcagccgcggtaatacgtagggggcaagcgttatccggaattattgggcgtaaagagtgcgtaggtggcaccttaagcgcagggtttaaggcaatggctcaaccattgttcgccctgcgaactggggggcttgagtgcaggagaggaaagcggaattcctagtgtagcggtgaaatgcgtagatattaggaggaacaccagtggcgaaggcggctttctggactgtaactgacactgaggcacgaaagcgtggggagcaaacaggattagataccctggtagtccacgccgtaaacgatgagcactaggtgtcggggtcgcaagacttcggtgccggagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatccctctgaccggttcttaatcggacctttcttcggacagaggagacaggtggtgcatggttgtcgtcagctcgtgtcgtgagatgttgggttaagtcccgcaacgagcgcaacccttgctgttagttgccatcattcagttgggcactctaacgggactgccggggacaactcggaggaaggtggggatgacgtcaaatcatcatgccccttatgttctgggctacacacgtgctacaatggccggtacagaaagcagcgaagtcgtgaggcggagcaaatctcgaaaaccggtcccagttcggactgcaggctgcaactcgcctgcacgaagccggagttgctagtaatcgcggatcagaatgccgcggtgaatgcgttcccgggtcttgtacacaccgcccgtcacaccatggaagttgggggtgcccgaagccggcaggagaatatgctgtcgaaggcaaaaccaatgactggggtgaagtcgtaacaaggtagccg

SEQ ID NO: 99 - DNA, 1497 bp, Artificial Sequence
  Synthetic Polynucleotide
gagagtttgatcctggctcaggatgaacgctggcggcgtgcttaacacatgcaagtcgaacgaagcatttagaacagattatttcggtatgaagttctttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggcccgtagaggcttcggcgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccg

SEQ ID NO: 100 - DNA, 1477 bp, Artificial Sequence
  Synthetic Polynucleotide
gagagtttgatcctggctcaggatgaacgctggcggcgtgcctaacacatgcaagtcgagcgagaagctcatcacagatgcttcggttgaagtgatgagtggaaagcggcggacgggtgagtaacgcgtaggcaacctgccctttgcagagggatagcctcgggaaaccgggattaaaacctcatgacacctcttaaagacatctttgagaggtcaaagatttatcggcaaaggatgggcctgcgtctgattagctagttggtggggtaacggcctaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggaagaaggcctttgggtcgtaaacttctgttctaagggaagataatgacggtaccttaggagcaagtcccggctaactacgtgccagcagccgcggtaatacgtagggggcaagcgttatccggaattattgggcgtaaagagtacgtaggtggttacctaagcacgaggtataaggcaatggcttaaccattgttcgccttgtgaactgggctgcttgagtgcaggagaggaaagcggaattcctagtgtagcggtgaaatgcgtagatattaggaggaacaccagtggcgaaggcggctttctggactgtaaccgacactgaggtacgaaagcgtggggagcaaacaggattagataccctggtagtccacgccgtaaacgatgagcactaggtgtcggggtcgcaagacttcggtgccgcagttaacgcaataagtgctccgcctggggagtacgttcgcaagaatgaaactcaaaggaattgacggggacccgcacaagcagcggagcatgtggtttaattcgaagcaacgcgaagaaccttaccaggacttgacatccctctgacagccttttaatcgaggttttctacggacagaggagacaggtggtgcatggttgtcgtcagctcgtgtcgtgagatgttgggttaagtcccgcaacgagcgcaacccttgtcattagttgccagcagtaagatgggcactctagtgagactgccgtggataacacggaggaaggtggggatgacgtcaaatcatcatgccccttatgttctgggctacacacgtgctacaatggccggtacagagagaagcgagactgcgaagtggagcgaaactcaaaagccggtcccagttcggattgcaggctgcaactcgcctgcatgaagtcggagttgctagtaatcgcagatcagaatgctgcggtgaatgcgttcccgggtcttgtacacaccgcccgtcacaccatggaagttgggggcgcccgaagttggcagataaatatgttacctaaggcgaaatcaatgactggggtgaagtcgtaacaaggtagccg

SEQ ID NO: 101 - DNA, 1497 bp, Artificial Sequence
  Synthetic Polynucleotide
gagagtttgatcctggctcaggatgaacgctggcggcgtgcttaacacatgcaagtcgaacgaagcatttaagacggattctttcgggatgaagacttttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtgtggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaattctaggtgtcggggagcacaagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcccgatgaccgttccgtaatgggaacttcccttcggggcatcggtgacaggtggtgcatggttgtcgtcagctcgtgtcgtgagatgttgggttaagtcccgcaacgagcgcaacccttaccttcagtagccagcagttcggctgggcactctggagggactgccagggataacctggaggaaggtggggatgacgtcaaatcatcatgccccttatgatttgggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacctaaccgtaaggaaggagctgccgaaggcgggactgataactggggtgaagtcgtaacaaggtagccg

SEQ ID NO: 102 - DNA, 1494 bp, Artificial Sequence
  Synthetic Polynucleotide
gagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtgaggctagagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccaaaagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtcctttccttcgggacagtggtgacaggtggtgcatggttgtcgtcagctcgtgtcgtgagatgttgggttgagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgcaagaaggagccgccgaaggcaggtttgataactggggtgaagtcgtaacaaggtagccg

SEQ ID NO: 103 - DNA, 1478 bp, Artificial Sequence
  Synthetic Polynucleotide
agagtttgatcctggctcaggatgaacgctggcggcgtgcctaacacatgcaagtcgagcgagaagtcatggatggaatcttcggaggaaagaaatgatggaaagcggcggacgggtgagtaacgcgtaggtaacctgccccatacagagggatagccactggaaacggtgattaatacctcatgacactttctcttcgcatggagaggaggtcaaagatttatcggtatgggatggacctgcgtctgattagcttgttggtggggtaacggcctaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggaagaaggcctttgggtcgtaaacttctgttctgagggaagaagaaagtgacggtacctcaggagaaagccccggctaactacgtgccagcagccgcggtaatacgtagggggcaagcgttgtccggaattattgggcgtaaagagtacgtaggcggtttgctaagcgcaaggtgaaaggcagtggcttaaccattgtaagccttgcgaactgacagacttgagtgcaggagaggaaagcggaattcctagtgtagcggtgaaatgcgtagatattaggaggaacaccggtggcgaaggcggctttctggactgtaactgacgctgaggtacgaaagcgtggggagcaaacaggattagataccctggtagtccacgccgtaaacgatgagcactaggtgtcgggatcgtaggatttcggtgccgcagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatccctctgacagagccttaaccggctccttcttcggacagaggagacaggtggtgcatggttgtcgtcagctcgtgtcgtgagatgttgggttaagtcccgcaacgagcgcaacccttgtcattagttactaacattaagttgaggactctaatgagactgccggggacaactcggaggaaggtggggatgacgtcaaatcatcatgccccttatgttctgggctacacacgtgctacaatggccggtacaaagagaagcaagaccgcgaggtggagcgaaactcaaaaaccggtcccagttcggactgcaggctgcagctcgcctgcacgaagttggagttgctagtaatcgcggatcagaatgccgcggtgaatgcgttcccgggccttgtacacaccgcccgtcacaccatggaagttgggggcgcccgaagttggtcgagaaatagattacctaaggcgaaaccaatgactggggtgaagtcgtaacaaggtagcc

SEQ ID NO: 104 - DNA, 1496 bp, Artificial Sequence
  Synthetic Polynucleotide
gagagtttgatcctggctcagattgaacgctggcggcatgccttacacatgcaagtcgaacggcagcgggggagcttgctcctgccggcgagtggcgaacgggtgagtaatgcatcggaacgtgtcctgttgtgggggataactgatcgaaagatcagctaataccgcatgagacctgagggtgaaagcgggggatcgaaagacctcgcgcgacaggagcggccgatgtctgattagctagttggtgagataaaagcttaccaaggcgacgatcagtagctggtctgagaggatgatcagccacattgggactgagacacggcccagactcctacgggaggcagcagtggggaattttggacaatgggggaaaccctgatccagccatgccgcgtgcgggatgaaggccttcgggttgtaaaccgcttttgtcagagacgaaaagggacgtacgaataatgcgtcccgctgacggtatctgaagaataagcaccggctaactacgtgccagcagccgcggtaatacgtagggtgcaagcgttaatcggaattactgggcgtaaagggtgcgcaggcggctgtgcaagacagatgtgaaatccccgggcttaacctgggaactgcatttgtgactgcacggctagagtttgtcagaggagggtggaattccgcgtgtagcagtgaaatgcgtagatatgcggaagaacaccaatggcgaaggcagccctctgggacatgactgacgctcatgcacgaaagcgtggggagcaaacaggattagataccctggtagtccacgccctaaacgatgtcagctgattgttcgggaagcaattcctgggtaaccaagccaacgcgtgaagctgaccgcctgggaagtacggtcgcaagattaaaactcaaaggaattgacggggacccgcacaagcggtggatgatgtggattaattcgacgcaacgcgaaaaaccttacctagccttgacatgtcaggaatccggatgaaagtctggagtgcccgcaagggagcctgaacacaggtgctgcatggctgtcgtcagctcgtgtcgtgagatgttgggttaagtcccgcaacgagcgcaacccttgtcatcagttgctacgcaagagcactctgatgagaccgccggtgacaaaccggaggaagatggggatgacgtcaagtcctcatggcccttacggctagggcctcacacgtcatacaatggtcggaacagagggcagcgaagccgggaggcggagctaatcccagaaaaccgatcgtagtccggattgcagtctgcaactcgaccgcatgaagtcggaatcgctagtaatcgcggatcagcatgccgcggtgaatacgttcccgggtcttgtacacaccgcccgtcacaccatgagagtcgggaacacccgaagtccgtagcctaacagcaatgggggcgcggccgaaggtgggttcgataattggggtgaagtcgtaacaaggtagccg

SEQ ID NO: 105 - DNA, 1507 bp, Artificial Sequence
  Synthetic Polynucleotide
tagagtttgatcctggctcaggatgaacgctagcgacaggcttaacacatgcaagtcgaggggcagcggggcaggaagcttgctttctgccgccggcgaccggcgcacgggtgagtaacacgtatgcaacctggccgtgacagatggataaccgggagaaatcccgcctaatacagcatgacgccgggaagggacatccctttccggccaaagggggcgactccggtcacggatgggcatgcggcgcattaggtagttggtggggcaacggcccaccaagccgacgatgcgtaggggttctgagaggaaggtcccccacattggaactgagacacggtccaaactcctacgggaggcagcagtgaggaatattggtcaatggccggaaggctgaaccagccaagtcgcgtgagggaataaggccctacgggtcgtaaacctcttttgtcagggagcaaggccgcccacgtgtggacggaaggagagtacctggagaaaaagcatcggctaactccgtgccagcagccgcggtaatacggaggatgcgagcgttatccggatttattgggtttaaagggtgcgtaggcggcctgccaagtcagcggtaaaattgcggggctcaaccccgtacagccgttgaaactgccgggctcgagtgggcgagaagtatgcggaatgcgtggtgtagcggtgaaatgcatagatatcacgcagaaccccgattgcgaaggcagcataccggcgccctactgacgctgaggcacgaaagtgcggggatcaaacaggattagataccctggtagtccgcacagtaaacgatgaatgctagctgtccggggggattgacccctgggtggcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgccgaagggacattccccgaaaggggattggccagcaatggtcttcggcgaggtgctgcatggttgtcgtcagctcgtgccgtgaggtgtcggcttaagtgccataacgagcgcaacccccaccgacagttgctaactggtcaagcagaggactctgtcgggactgccggcgcaagctgcgaggaaggcggggatgacgtcaaatcagcacggcccttacgtccggggcgacacacgtgttacaatggcaggtacagcgggatgccatggggcgacccagagcggaacccgaaaacctgtctcagttcggattggagtctgcaacccgactccatgaagctggattcgctagtaatcgcgcatcagccatggcgcggtgaatacgttcccgggccttgtacacaccgcccgtcaagccatggaagccgggagtgcctgaagtgtgcaaccgcaaggagcgccctaaggtaaaactggtgactggggctaagtcgtaacaaggtaaccgta

SEQ ID NO: 106 - DNA, 1477 bp, Artificial Sequence
  Synthetic Polynucleotide
gagagtttgatcctggctcaggatgaacgctggcggcgtgcctaacacatgcaagtcgagcgagaagctttgaactgacgcttcggttgatgatcaaagtggaaagcggcggacgggtgagtaacgcgtaggcaacctgccctttgcagagggatagcctcgggaaaccgggattaaaacctcataacgcacaaccgggacatcttggatgtgccaaagatttatcggcagaggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggatgaaggcccttgggtcgtaaacttctgttctaggggaagatagtgacggtaccttaggagcaagtcccggctaactacgtgccagcagccgcggtaatacgtagggggcaagcgttatccggaattattgggcgtaaagagtacgtaggtggttacctaagcaaggggtttaaggcaatggcctaactattgttcgccccttgaactgggctacttgagtgcaggagaggaaagcggaattcctagtgtagcggtgaaatgcgtagatattaggaggaacaccagtggcgaaggcggctttctggactgtaactgacactgaggtacgaaagcgtggggagcaaacaggattagataccctggtagtccacgccgtaaacgatgagcactaggtgtcggggtcgcaagacttcggtgccgcagttaacgcaataagtgctccgcctggggagtacgttcgcaagaatgaaactcaaaggaattgacggggacccgcacaagcagcggagcatgtggtttaattcgaagcaacgcgaagaaccttaccagggcttgacatcttcctgacagacccttaaacgggtccttcttcggacaggaaagacaggtggtgcatggttgtcgtcagctcgtgtcgtgagatgttgggttaagtcccgcaacgagcgcaacccttgctgttagttgccatcattaagttgggcactctaacgggactgccggggataactcggaggaaggtggggatgacgtcaaatcatcatgccccttatgttctgggctacacacgtgctacaatggccggtacaaagagaagcgagaccgcgaggtggagcgaatctcaaaagccggtcccagttcggattgcaggctgcaactcgcctgcatgaagtcggagttgctagtaatcgcgaatcagaatgtcgcggtgaatgcgttcccgggtcttgtacacaccgcccgtcacaccatggaagttgggggcgcccgaagttggcaggcaaatatgttacctaaggcgaaaccaatgactggggtgaagtcgtaacaaggtagccg

SEQ ID NO: 107 - DNA, 1489 bp, Artificial Sequence
  Synthetic Polynucleotide
agagtttgatcctggctcaggatgaacgctagcgacaggcttaacacatgcaagtcgaggggcatcggggatgtagcaatacatctgccggcgaccggcgcacgggtgagtaacgcgtatgcaacctgcccgtcactgggggataaccgggagaaattccgactaataccgcatatgattcctgaacgaatgttcgggttttgaaagatttatcggtgaaggatgggcatgcgtgatattaggtagttggcggggtaacggcccaccaagccgacgatatctaggggttctgagaggaaggtcccccacactggtactgagacacggaccagactcctacgggaggcagcagtgaggaatattggtcaatggacgtaagtctgaaccagccaagtcgcgtgaaggatgacggccctacgggttgtaaacttctttagtgcgggaacaaataaaggcacgtgtgccttgttgagtgtaccgcaagaataagcatcggctaactccgtgccagcagccgcggtaatacggaggatgcgagcgttatccggatttattgggtttaaagggtgcgcaggctgtcgtgcaagtcagcggtcaaatgtcggggctcaaccccggcctgccgttgaaactgcatggctggcgtgagtgtgaggtaggcggaatgcgttgtgtagcggtgaaatgcatagatatgacgcagaactccgattgcgaaggcagcttaccaacactttacggacgctgaggcacgaaagcgtgggtatcgaacaggattagataccctggtagtccacgcagtaaacgatgaatactaattgttcggggggcaacccctgagtgatacagcgaaagcgttaagtactccacctggggagtacgccggcaacggtgaaactcaagggaattgacgggggcccgcacaagcggaggaacatgtggtttaattcgatgatacgcgaggaaccttacccgggctcaaacgttgggggaatgctcctgaaagggagcagccagcaatggtcgccaacgaggtgctgcatggttgtcgtcagctcgtgccgtgaggtgtcggcttaagtgccataacgagcgcaacccctgcgtccagttaccatcaagtcatgttggggactctggacggactgccggcgcaagccgtgaggaaggcggggatgacgtcaaatcagcacggcccttacgtccggggcgacacacgtgctacaatggcgtggacagcgggaagccacctggcgacagggagcggacccctaaaacacgtctcagttcggattggagtctgcaactcgactccatgaagctggattcgctagtaatcgcgcatcagccatggcgcggtgaatacgttcccgggccttgtacacaccgcccgtcaagccatgggagccgggagtgcctgaagtacgtaaccggaaggagcgtccaagggtaacactggtgactggggctaggtcgtaacaaggtagcc

SEQ ID NO: 108 - DNA, 1499 bp, Artificial Sequence
  Synthetic Polynucleotide
tagagtttgatcatggctcaggatgaacgctagcgacaggcttaacacatgcaagtcgaggggcagcggggaggtagcaatacttccgccggcgaccggcgcacgggtgagtagcacgtatggaacctgcccgtagcagggggataagcggaagaaattccgtctaataccgcgtaataactccgagaggcatctcctggggtttaaagggtaacaccggctacggatggccatgcggcgcattagctagttggcggggtaacggcccaccaaggcgacgatgcgtaggggttctgagaggaaggtcccccacactggtactgagacacggaccagactcctacgggaggcagcagtgaggaatattggtcaatgggcgcgagcctgaaccagccaagtcgcgtgagggaagacggtcctatggattgtaaacctcttttgtcggggagcaaattccgccacgtgtggcggagtcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatactagctgtccggggcgaatgagccctgggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacacaggaacggtcctgaaaggggtcggctctacggagcctgtgccgaggtgctgcatggttgtcgtcagctcgtgccgtgaggtgtcggcttaagtgccataacgagcgcaacccccatcgacagttgctaacaggtcaagttgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtctcagttcggattggagtctgcaacccgactccatgaagctggattcgctagtaatcgcgcatcagccacggcgcggtgaatacgttcccgggccttgtacacaccgcccgtcaagccatggaagccgggggtgcctgaagtgcgctgccgcaaggagcgccctagggtaaaaccggtgactggggctaagtcgtaacaaggtaaccgta

SEQ ID NO: 109 - DNA, 1492 bp, Artificial Sequence
  Synthetic Polynucleotide
gagagtttgatcctggctcaggacgaacgctggcggcgtgcttaatacatgcaagtcgaacgaagctgcatataggaagccttcgggtggaatagatgtagacttagtggcggacgggtgagtaacgcgtgagcaacctgcccataagagggggacaacagttggaaacgactgctaataccgcataagaccacgctatcgcatgatagaggggtcaaagaaatatcgcttatggatgggctcgcgtcccattaggtagttggtgaggtaacggcccaccaagccgacgatgggtagccgacctgagagggtgatcggccacattggaactgagacacggtccaaactcctacgggaggcagcagtagggaatattgggcaatgggggcaaccctgacccagcaacgccgcgtgagggaagaaggtctctggattgtaaacctctgtcctatgggacgaagaagtgacggtaccataggaggaagctccggctaactacgtgccagcagccgcggtaatacgtagggagcgagcgttgtccggaattactgggcgtaaagggtgcgtaggcggcctggtaagtcagatgtgaaatacccgtgctcaacatggggggtgcatctgatactgttaggcttgagtgcaggagaggaaagcggaattcctagtgtagcggtgaaatgcgtagatattaggaggaacaccagtggcgaagcggctttctggactgtaactgacgctgaggcacgaaagcgtggggagcaaacaggattagataccctggtagtccacgctgtaaacgatggatactaggtgtgggggtcaaaagacttctgtgccgcagcaaacgcaataagtatcccgcctggggagtacgaccgcaaggttgaaactcaaaggaattgacgggggcccgcacaagcagcggagcatgtggtttaattcgaagcaacgcgaagaaccttaccaaggcttgacatcctctgacgaatgtagagatacattttcccttcggggcagagagacaggtggtgcatggttgtcgtcagctcgtgtcgtgagatgttgggttaagtcccgcaacgagcgcaacccttatcaatagttgccagcacttcgggtgggaactctattgagactgccggggacaactcggaggaaggtggggacgacgtcaaatcatcatgccccttatgtcttgggctacacacgtgctacaatggccggtacaaagggcagcgaacctgcaaaggcaagcgaatctcaaaaagccggtctcagttcggattgtgggctgcaacccgcccacatgaagtcggagtcgctagtaatcgcgaatcagcatgtcgcggtgaatgcgttcccgggccttgtacacaccgcccgtcacaccacggaagttgggggcgcccgaagccgatgtcctaaccgcaaggagggagtcgtcgaaggtgaaaccaatgactggggtgaagtcgtaacaaggtagccg

SEQ ID NO: 110 - DNA, 1460 bp, Artificial Sequence
  Synthetic Polynucleotide
gatgaacgctggcggcgtgcttaacacatgcaagtcgaacgggaattactttattgaaacttcggtcgatttaatttaattctagtggcggacgggtgagtaacgcgtgggtaacctgccttgtacagggggataacagtcagaaatgactgctaataccgcataagcgcacaggaccgcatggtccggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgggcaatgggcgcaagcctgacccagcaacgccgcgtgagggaagaaggttttcggattgtaaacctctgtcgcagaagacgaaggaagtgacggtatttctgtgaggaagccccggctaactacgtgccagcagccgcggtaatacgtagggggcgagcgttgtccggaattactgggcgtaaagggtgcgtaggcggttaattaagttggatgtgaaattcccgggcttaacttgggagctgcattcaaaactggttaactagagttcaggagagggaagcggaattcctagtgtagcggtgaaatgcgtagatattaggaggaacaccggtggcgaaggcggctttctggactgacactgacgctgaggcacgaaagcgtggggagcaaacaggattagataccctggtagtccacgctgtaaacgatgaatactaggtgtagggggtatgaactccctctgtgccgcagcaaacgcaataagtattccgcctggggagtacggccgcaaggttgaaactcaaaggaattgacgggggcccgcacaagcagcggagcatgtggtttaattcgacgcaacgcgaagaaccttaccaaggcttgacatctacttaagctcatggaaacatgaggtcccttcgggggaagtaagacaggtggtgcatggttgtcgtcagctcgtgtcgtgagatgttgggttaagtcccgcaacgagcgcaacccctgttgccagttaccagcaagtaaagttggggactctggtgagactgccggggacaactcggaggaaggtggggacgacgtcaaatcatcatgccccttatgtcttgggctacacacgtgctacaatggctgtaacaaagggaagcgaccttgtaagaggaagcggatctcagaaaagcagtcccagttcggattgtgggctgcaacccgcccacatgaagtcggagttgctattttatcgcggatcagcatgccgcggtgaatacgttcccgggccttgtacacaccgcccgtcacaccatgggagttgggagcgcccgaagccggtatcctaacctgaaaaggagggagccgtcgaaggtgagaccaatgactggggtg

SEQ ID NO: 111 - DNA, 1476 bp, Artificial Sequence
  Synthetic Polynucleotide
agagtttgattatggctcaggatgaacgctggcggcgtgcctaacacatgcaagtcgagcgagaagctgatgacagatacttcggttgaaggagtcagtggaaagcggcggacgggtgagtaacgcgtaggcaacctgccctttgcacagggatagccattggaaacgatgattaaaacctgataacaccatttggttacatgagcagatggtcaaagatttatcggcaaaggatgggcctgcgtctgattagctagttggtaaggtaacggcttaccaaggcgacgatcagtagccgacctgagagggtgaacggccacattggaactgagacacggtccaaactcctacgggaggcagcagtggggaatattgcacaatgggcgaaagcctgatgcagcaacgccgcgtgaaggaagaaggccttcgggtcgtaaacttctgtccttggggaagaagaactgacggtacccaaggaggaagccccggctaactacgtgccagcagccgcggtaatacgtagggggcaagcgttatccggaattattgggcgtaaagagtacgtaggtggcaacctaagcgcagggtttaaggcaatggctcaaccattgttcgccctgcgaactgggatgcttgagtgcaggagaggaaagcggagttcctagtgtagcggtgaaatgcgtagatattaggaggaacaccagtggcgaaggcggctttctggactgtaactgacactgaggtacgaaagcgtggggagcaaacaggattagataccctggtagtccacgccgtaaacgatgagcactaggtgtcggggtcgcaagacttcggtgccgtagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatccctctgacagacccttaatcgggtttttctacggacagaggagacaggtggtgcatggttgtcgtcagctcgtgtcgtgagatgttgggttaagtcccgcaacgagcgcaacccttgccattagttgccagcagtaagatgggcactctagtgggactgccggggacaactcggaggaaggtggggatgacgtcaaatcatcatgccccttatgttctgggctacacacgtgctacaatggccggtacagaaagcagcgaagtcgtgaggcggagcaaatctcgaaaaccggtcccagttcggactgcaggctgcaactcgcctgcacgaagccggagttgctagtaatcgcggatcagaatgccgcggtgaatgcgttcccgggtcttgtacacaccgcccgtcacaccatggaagttgggggtgcccaaagccggcaaggaaatatgctgtctaaggcaaaaccaatgactggggtgaagtcgtaacaaggtaac

SEQ ID NO: 112 - DNA, 1504 bp, Artificial Sequence
  Synthetic Polynucleotide
gacgaacgctggcggcgtgcttaacacatgcaagtcgaacgaagcagcttaacggaactcttcggagggaagataagttgactgagtggcggacgggtgagtaacgcgtgagcaacctgcccataagagggggataacagttggaaacgactgctaataccgcataagaccacattaccgcatggtagaggggtcaaagaaattcgcttatggaggggctcgcgtcccattaggtagttggtagggtaaaggcctaccaagccgacgatgggtagccgacctgagagggtgatcggccacactggaactgagacacggtccagactcctacgggaggcagcagtggggaatattgggcaatgggcgcaagcctgacccagcaacgccgcgtgagggaagaaggccttcgggttgtaaacctctgtcctatgggaagaagaaagtgacggtaccataggaggaagctccggctaactacgtgccagcagccgcggtaatacgtagggagcaagcgttgtccggaattactgggcgtaaagggtgcgtaggcggttgtttaagtcagatgtgaaatacccgggcttaacccgggggctgcatctgatactggataactagagtgcaggagaggaaagtggaattcctagtgtagcggtggaatgcgtagatattaggaggaacaccagtggcgaaggcgactttctggactgtaactgacgctgaggcacgaaagtatgggtagcaaacaggattagataccctggtagtccatactgtaaacgatgaatactaggtgtgggggacaatagtcttccgtgccgcagccaacgcaataagtattccgcctggggagtacggtcgcaagactgaaactcaaaggaattgacgggggcccgcacaagcagcggagcatgtggtttaattcgaagcaacgcgaagaaccttaccaaggcttgacatcccggtgaccggcatagagatatgccttctcttcggagcaccggtgacaggtggtgcatggttgtcgtcagctcgtgtcgtgagatgttgggttaagtcccgcaacgagcgcaacccttgttactagttgccagcatttcggatgggaactctagtgagactgccggggataactcggaggaaggtggggatgacgtcaaatcatcatgccctttatgtcttgggctacacacgtgctacaatggtcggtacaaagagcggcgagctcgtaagagtaagcgaatctcataaagccggtctcagttcagattgtgggctgcaacccgcccacatgaagtcggagttgctagtaatcgcggatcagcatgccgcggtgaatgcgttcccgggccttgtacacaccgcccgtcacaccatggaagttgggggcgcccgaagccgatggcctaaccgcaaggagggagtcgtcgaaggtgaaaccaatgactggggtgaagtcgtaacaaggtagccgtatcggaaggtgcggctggatcacctcctt

SEQ ID NO: 113 - DNA, 1472 bp, Artificial Sequence
  Synthetic Polynucleotide
gacgaacgctggcggcgtgcttaacacatgcaagtcgaacggagagcgtggaaggcaacggaagcgctcttagtggcggacgggtgcgtaacgcgtgagcaatctatcctgcggagggggataacatctggaaacagatgctaataccgcatgagaccacagcctcgcatgagggaggggtcaaaggagaaatccgcggcagggtgagctcgcgtcccattagatagttggtgaggtaacggcccaccaagtcaacgatgggtagccgatctgagaggatgaccggccacattggaactgagaaacggtccagactcctacgggaggcagcagtggggaatattgggcaatgggcgaaagcctgacccagcaacgccgcgtgagggaagaaggttttcggatcgtaaacctctgttgtgggggacgaggagatgacggtaccccacgaggaagctccggctaactacgtgccagcagccgcggtaatacgtagggagcgagcgttgtccggaatgactgggcgtaaagggcgcgtaggcggcctggcaagtttggagtgaaagccccattttcaaggtggggactgctttgaagactgcgaggcttgagtgagggagaggatagcggaattcccggtgtagcggtgaaatgcgtagagatcgggaggaacaccagtggcgaaggcggctatctggacctagactgacgctgaggcgcgaaagcgtggggagcaaacaggattagataccctggtagtccacgctgtaaacgatggatgctaggtgtaggaggtatcgaccccttctgtgccggagtaaacacaataagcatcccgcctggggagtacggccgcaaggttgaaactcaaaggaattgacgggggcccgcacaagcagcggagcatgtggtttaattcgaagcaacgcgaagaaccttaccaggtcttgacatccaattaaagctgcggaaaggcagtgtctcttcggaggaattgagacaggtggtgcatggttgtcgtcagctcgtgtcgtgagatgttgggttaagtcccgcaacgagcgcaacccttgcgattggttgctaacagggaagctgagaactccaataggactgccggggacaactcggaggaaggtggggacgacgtcaaatcatcatgccccttatgacctgggctacacacgtgctacaatggccactacaaagaggagcgaacccgtaagggggagcagatctgagaaaagtggtcccagttcggattgtgggctgcaacccgcccacatgaagtcggagttgctagtaatcgcggatcagcatgccgcggtgaatacgttcccgggccttgtacacaccgcccgtcacaccatgggagttgggagcacccgaagcctgtgagctaacgcaagaggcagcagtcgaaggtgagaccaatgactggggtgaagtcgtaacaaggtagccgtatcggaagg

SEQ ID NO: 114 - DNA, 1402 bp, Artificial Sequence
  Synthetic Polynucleotide
agagtttgatcctggctcaggatgaacgctagcggcaggcttaacacatgcaagtcgaacggcagcggggattcacttcggtgaatctgccggcgagtggcgcacgggtgagtaacacgtatgcaacctgcctctgtcaggggtataactctgcgaaagtagggctaataccgcgtatattcccggagggcatcctccggggaggaaaggtttcggccggacagagatgggcatgcggcgcattaggcagttggcggggtaacggcccaccaaaccgacgatgcgtaggggttctgagaggaaggtcccccacactggtactgagacacggaccagactcctacgggaggcagcagtgaggaatattggtcaatggtcgggagactgaaccagccaagccgcgtgagggaggaaggtacagagtatcgtaaacctcttttgtcagggaacaaagactgggatgcgtccccggatgagtgtacctgaagaaaaagcatcggctaactccgtgccagcagccgcggtaatacggaggatgcgagcgttatccggatttattgggtttaaagggtgcgcaggcggtctgttaagtcagcggtcaaagcccggggctcaaccccggcccgccgttgaaactggcagtctcgagttggagagaagtatgcggaatgcgcagtgtagcggtgaaatgcatagatatcgcgcagaactccgattgcgaaggcagcatgccggctccacactgacgctgaggcacgaaagcgtgggtatcgaacaggattagataccctggtagtccacgcagtaaacgatgaatgctggctgtccggggggactgacccctgggtggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacggggagtgccgcaggcagagacgcctgtttcccacgggacactccccgaggtgctgcatggttgtcgtcagctcgtgccgtgaggtgtcggcttaagtgccataacgagcgcaacccccgcgtgcagttgctaacagataacgctgaggactctgcacggactgccggcgcaagccgcgaggaaggcggggatgacgtcaaatcagcacggcccttacgtccggggcgacacacgtgttacaatgggtggtacagcgggaagccaggcggcgacgccgagcggaacccgaaatccactctcagttcggatcggagtctgcaacccgactccgtgaagctggattcgctagtaatcgcgcatcagccatggcgcggtgaacacgttcccgggccttgcacacaccgcccgtca

SEQ ID NO: 115 - DNA, 1410 bp, Artificial Sequence
  Synthetic Polynucleotide
agagtttgatcctggctcaggatgaacgttggcggcgtgcttaacacatgcaagtcgaacgaagcacttaagaacgattcttcggatgaagtcttttgtgactgagtggcggacgggtgagtaacgcgtgggtaacctgcctcacacagggggataagcggaagaaattccgcctaataccgcgtaacattctccggaggcatctccggggaatcaaagattcatcggttgcggatggccatgcggcgcattagctagtcggcggggtaacggcccaccgaggcgacgatgcgtaggggtttctgagaggaaggtcccccacactggtactgagacacggaccagactcctacgggaggcagcagtgaggaatattggtcaatggccgagaggctgaaccagccaagtcgcgtgagggatgacggccctacgggttgtaaacctcttttgtcagggagcaaggggcatcacgtgtgatgctgtgagagtacctgaagaaaaagcatcggctaactccgtgccagcagccgcggtaatacggaggatgggagcgttatccggatttattgggtttaaagggtgcgcaggcggactctcaagtcagcggtcaaatcgcggggctcaaccccgttccgccgttgaaactgggagccttgagtgcgcgagaagtaggcggaatgcgtggtgtagcggtgaaatgcatagatatcacgcagaactccgattgcgaaggcagcctaccggcgcgcaactgacgctcatgcacgaaagcgtgggtatcgaacaggattagataccctggtagtccacgcagtaaacgatgaacactaactgtccggcccgattgggggctgggtggtacagcgaaagcgttaagtgttccacctggggagtacgccggcaacggtgaaactcaaaggaattgacgggggcccgcacaagcggaggaacatgtggtttaattcgatgatacgcgaggaaccttacccgggctcaaacgacggatgaatgtttttgaaaggaggcagcccttcggggcatccgtcgaggtgctgcatggttgtcgtcagctcgtgccgtgaggtgtcggcttaagtgccataacgagcgcaacccccatcgccagttgccatcaggtaaagctgggcactctggcgagactgccggcgcaagctgtgaggaaggcggggatgacgtcaaatcagcacggcccttacgtccggggcgacacacgtgttacaatggcaggtacagatagaagccaggcggcgacgccgagcggaacccgaaagcctgtctcagttcggatcggagtctgcaacccgactccgtgaagctggattcgctagtaatcgcgaatcagaatgtcgcggtgaatacgttcccgggtcttgcacacaccgcccgtca

SEQ ID NO: 116 - DNA, 1406 bp, Artificial Sequence
  Synthetic Polynucleotide
agagtttgatcctggctcaggatgaacgctagcgacaggcctaacacatgcaagtcgaggggcatcgggggagagagcttgctctctcctgccggcgaccggcgcacgggtgagtaacgcgtatgcgacctgccccgcacagacggataacccggagaaatccggactaatacggcatgacaccgttcctctgcatgggggagcggtcaaaggagcgatccggtgcgggatgggcatgcgtgacattagctagttggcggggcaacggcccaccaaggcgacgatgtctaggggttctgagaggaaggtcccccacactggtactgagacacggaccagactcctacgggaggcagcagtgaggaatattggtcaatgggcgatagcctgaaccagccaagtcgcgtgagggaagacggccctacgggttgtaaacctcttttgccggggagcaacggccgccacgtgtggcggagacgagagtacccggagaaaaagcatcggctaactccgtgccagcagccgcggtaatacggaggatgcgagcgttatccggatttattgggtttaaagggtgcgtaggcgggcttttaagtcagcggtcaaatatcggggctcaaccccgtggagccgttgaaactgggagccttgagtgggcgagaagtatgcggaatgcgtggtgtagcggtgaaacgcatagatatcacgcagaactccgattgcgaaggcagcataccggcgcccaactgacgctgaagcacgaaagcgtgggtatcgaacaggattagataccctggtagtccacgcagtaaacgatgaacactagctgtccgggccgattgaggcttgggtggcacagcgaaagcgttaagtgttccacctggggagtacgccggcaacggtgaaactcaaaggaattgacgggggcccgcacaagcggaggaacatgtggtttaattcgatgatacgcgaggaaccttacccgggctcaaacggaacaggaatgtttttgaaaggaggcagccagcaatggcctgttccgaggtgctgcatggttgtcgtcagctcgtgccgtgaggtgtcggcttaagtgccataacgagcgcaacccctaccgacagttgctaactggttaagcagaggactctgtcgggactgccggcgcaagctgcgaggaaggcggggatgacgtcaaatcagcacggcccttacgtccggggcgacacacgtgttacaatggcaggtacagcgggaagccacttggcgacaaggagcggagcccgaaaacctgtctcagttcggattggagtctgcaacccgactccatgaagctggattcgctagtaatcgcgcatcagccacggcgcggtgaatacgttcccgggccttgcacacaccgcccgtca

SEQ ID NO: 117 - DNA, 1386 bp, Artificial Sequence
  Synthetic Polynucleotide
agagtttgatcctggctcaggatgaacgctggcggcgtgcctaacacatgcaagtcgagcgagaagctgatgacagatacttcggttgaaggagtcagtggaaagcggcggacgggtgagtaacgcgtaggcaacctgccctttgcacagggatagccattggaaacgatgattaaaacctgataacaccatttggttacatgagcagatggtcaaagatttatcggcaaaggatgggcctgcgtctgattagctagttggtaaggtaacggcttaccaaggcgacgatcagtagccgacctgagagggtgaacggccacattggaactgagacacggtccaaactcctacgggaggcagcagtggggaatattgcacaatgggcgaaagcctgatgcagcaacgccgcgtgaaggaagaaggccttcgggtcgtaaacttctgtccttggggaagaagaactgacggtacccaaggaggaagccccggctaactacgtgccagcagccgcggtaatacgtaggtggcaagcgttgtccggaattactgggtgtaaagggagcgcaggcgggaagccaagtcagctgtgaaaactacgggcttaacttgtagactgcagttgaaactggttttcctgagtgaagtagaggttggcggaattcctagtgtagcggtgaaatgcgtagatattaggaggaacaccagtggcgaaggcggctttctggactgtaactgacactgaggtacgaaagcgtggggagcaaacaggattagataccctggtagtccacgccgtaaacgatgagcactaggtgtcggagtcgcaagacttcggtgccgtagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatccctctgacagacccttaatcgggtttttctacggacagaggagacaggtggtgcatggttgtcgtcagctcgtgtcgtgagatgttgggttaagtcccgcaacgagcgcaacccttgccattagttgccagcagtaagatgggcactctagtgggactgccggggacaactcggaggaaggtggggatgacgtcaaatcatcatgccccttatgttctgggctacacacgtgctacaatggccggtacagaaagcagcgaagtcgtgaggcggagcaaatctcgaaaaccggtcccagttcggactgcaggctgcaactcgcctgcacgaagccggagttgctagtaatcgcggatcagaatgccgcggtgaatgcgttcccgggtcttgcacacaccgcccgtca

SEQ ID NO: 118 - DNA, 1408 bp, Artificial Sequence
  Synthetic Polynucleotide
agagtttgatcctggctcagattgaacgctggcggcgtgcttaacacatgcaagtcgagcgagaaagttccttcgggaatgagtagagtggcgcacgggtgagtaacgcgtggataatctaccggggagtgaggaataacagttggaaacgactgctaataccgcatacgctgcatattatgatttatgcaggaaaggaggcctctgcatatgcttccgcttttcgatgagtccgcgtcccattagctggttgggggggtaacggcccaccaaggcgacgatgggtagctggtctgagaggatgatcagccacactgggactggaacacggcccagactcctacgggaggcagcagtggggaatattgcgcaatgggcgaaagcctgacgcagcgacgccgcgtgagggatgaaggttctcggatcgtaaacctctgtcagaagggaagaaattatatcatgctaatcagtggtgtattgacggtaccttcaaaggaagcaccggctaactccgtgccagcagccgcggtaatacggagggtgcgagcgttaatcggaattactgggcgtaaagcgcacgtaggctgtatgacaagtcaagggtgaaatgccacggctcaaccgtggaactgcctttgaaactgtcaaactggagtatgtgagagggcggcggaattcctggtgtaggagtgaaatccgtagatatcaggaggaacatcagtggcgaaggcggccgcctggcacaaaactgacgctgaggtgcgaaagcgtgggtagcaaacaggattagataccctggtagtccacgctgtaaacgatggatactaagtgttgggttgtatgactcggcgccctaactaacgcgttaagtatcccgcctgggggagtacggtcgccaggctgaaactcaaagaaattgacgggggcccgcacaagcggtggagtaggtggtttaattcgatgcaacgcgaagaaccttacccaggcttgacatccagggaacccctatgaaaatagggggtactcttcggaggaccctgagacaggtgctgcatggctgtcgtcagctcgtgccgtgaggtgttgggttaagtcccgcaacgagcgcaacccctgtccttagttgccatcaggtaaggctgggcactctagggagaccgccccggttaacggggaggaaggtggggacgacgtcaagtcatcatggcccttacgcctggggctacacacgtactacaatggcgcatacaaagggaagcgagaccgtgaggtgaagccaatctcaaaaaatgcgtcccagttcggattggagtctgcaactcgactccatgaagtcggaatcgctagtaattccggatcagcatgccggggtgaatgcgttcccgggccttgcactcacagcccgtca

SEQ ID NO: 119 - DNA, 1405 bp, Artificial Sequence
  Synthetic Polynucleotide
agagttttatcctggctcaggatgaacgctagcgacaggcctaacacatgcaagtcgaggggcatcggggagcgaagcttgctttgctccgccggcgaccggcgcacgggtgagtaacgcgtatgcaacctgcccgtttcagcgggataacccggagaaatccggcctaataccgcatgtggccgagggaaggcatcttctttcggccaaaggaggcgactccggagacggatgggcatgcgtgacattagcttgttggcggggtaacggcccaccaaggcgacgatgtctaggggttctgagaggaaggtcccccacactggtactgagacacggaccagactcctacgggaggcagcagtgaggaatattggtcaatgggcgagagcctgaaccagccaagtcgcgtgaaggatgacggccctacgggttgtaaacttcttttgtcagggagcaattgggtccacgtgtgggcttagcgagagtacctgaagaaaaagcatcggctaactccgtgccagcagccgcggtaatacggaggatgcgagcgttatccggatttattgggtttaaagggtgcgtaggcggaatatcaagtcagcggtaaaaattcggggctcaaccccgtcgtgccgttgaaactgatgttcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatgctaattgtccggagggattgacctctgggtgatacagcgaaagcgttagcattccacctggggagtacgccggcaacggtgaaactcaaaggaattgacgggggcccgcacaagcggaggaacatgtggtttaattcgatgatacgcgaggaaccttacccgggctcaaacggaaggggacagtatgagaaatcatacattccttcgggaccgcttccgaggtgctgcatggttgtcgtcagctcgtgccgtgaggtgtcggcttaagtgccataacgagcgcaacccctatcgacagttgctagcaggtaaagctgaggactctgtcgagactgccggcgcaagctgtgaggaaggcggggatgacgtcaaatcagcacggcccttacgtccggggcgacacacgtgttacaatggcaggtacagcgggaagccacccggcgacggggcgcagaacccgaaaacctgtctcagttcggattggagtctgcaacccgactccatgaagctggattcgctagtaatcgcgcatcagccacggcgcggtgaatacgttcccgggccttgcactcaccgcccgt

SEQ ID NO: 120 - DNA, 1448 bp, Artificial Sequence
  Synthetic Polynucleotide
gcatgcctaacacatgcaagtcgaacggagattacttcggtaatcttagtggcgaacgggtgagtaacgcgtgggcaacctaccctctagatggggacaacatcccgaaaggggtgctaataccgaatgtgacagcaatctcgcatgaggatgctgtgaaagatggcctctatttataagctatcgctagaggatgggcctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcaggttgtgaataatgacttgtaatgacggtagtaaacgaataagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtataggtgtaggaggtatgaccccttctgtgccggagttaacgcaataagtaccccgcctgggggaggaaggtccggcaaaggatggaaactcaaaggaattgaacgggggcccgcacaagcggtggagtatgggtttattgacgaaagcgaaggaccttacccaaggcttgacattgaaagaccgctccagagatggaggtttcccttcggggacatgaaaacaggtggtgcatggcttgtcgtcagcttgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcggcaacagagggaagcgaagccgtgaggcagagcaaaccccagaaacccgatctcagttcggattgcaggctgcaactcgcctgcatgaagtcggaatcgctagtaatcgcaggtcagcatactgcggtgaatacgttcccgggccttgtacacaccgcccgtcacaccacgaaagttggtaacacccgaagccggtggggtgaccgtaaggagtccagccgtctaaggtgggg

SEQ ID NO: 121 - DNA, 1403 bp, Artificial Sequence
  Synthetic Polynucleotide
gtttgatcctggctcaggatgaacgctagcgacaggcttaacacatgcaagtcgaggggcagcgggaggaaagcttgcttttcttgccggcgaccggcgcacgggtgagtaacacgtatgcaacctgcccatgacagggggataagcgggagaaattccgtctaataccgcataacacccccgggagacatctctcgggagtcaaaggagcgatccggtcatggatgggcatgcggcgcattagttagttggcggggtaacggcccaccaaggcgacgatgcgtaggggttctgagaggaagggcccccacactggtactgagacacggaccagactcctacgggaggcagcagtgaggaatattggtcaatgggcgagagcctgaaccagccaagtcgcgtgagggaagacggccctacgggttgtaaacctcttttgtcagggagcaagaaaaggcacgcgtgccttactgagagtacctgaagaaaaagcatcggctaactccgtgccagcagccgcggtaatacggaggatgcgagcgttatccggatttattgggtttaaagggtgcgtaggcgggctgccaagtcagcggtaaaattgcggggctcaaccccgtcgagccgttgaaactggtggccttgagtgggcgagaagtacgcagaatgtgtggtgtagcggtgaaatgcatagatatcacgcagaactccgattgcgaaggcagcgtaccggcgccctactgacgctgaagcacgaaagcgtgggtatcgaacaggattagataccctggtagtccacgcagtaaacgatgaatgctagctgtcccgggacgaatgagtccttgggtggcacaagggaaagcgttaagcattccacttggggagtacgcgggcaacggtgaaattcaaaggaatggacgggggcccgcacaagcggaggaacatgtggtttaattcgatgatacgcgaggatctttaccggggctcaaacgcactacgaatgatgctgaaaggtgtcagccagcaatggcgtagtgcgaggtgctgcatggttgtcgtcagctcgtgccgtgaggtgtcggcttaagtgccataacgagcgcaacccctaccgacagttgctaactggtcaagcagaggactctgtcgggactgccggcgcaagctgtgaggaaggcggggatgacgtcaaatcagcacggcccttacgtccggggcgacacacgtgttacaatggcaggtacagcgggaagccacctggcgacagggagcggaacccgaaaacctgtctcagttcggattggagtctgcaacccgactccatgaagctggattcgctagtaatagcgcatcagccatggcgcggtgaatacgttcccgggccttgtactcaccgcccgtca

SEQ ID NO: 122 - DNA, 1402 bp, Artificial Sequence
  Synthetic Polynucleotide
agagtttgatctggctcaggatgaacgctagcgacaggcttaacacatgcaagtcgaggggcagcgggggagtagcaatactcccgccggcgaccggcgcacgggtgagtaacacgtatgaaacctgcccgtagcagggggataagcggaagaaattccgtctaataccgcgtaacaacccgaggaggcatctcctcgggtttaaaggaggcgattccggctacggatggtcatgcgtcgcattagctagttggcggggtaacggcccaccaaggcgacgatgcgtaggggttctgagaggaaggtcccccacactggtactgagacacggaccagactcctacgggaggcagcagtgaggaatattggtcaatggccgagaggctgaaccagccaagtcgcgtgagggaagaatgtcctatggattgtaaacctcttttgtcagggagcaaagtcacccacgtgtgggtgctggagagtacctgaagaaaaagcatcggctaactccgtgccagcagccgcggtaatacggaggatgcgagcgttatccggatttattgggtttaaagggtgcgtaggcgggttatcaagtcagcggtaaaatcgtggagctcaactccatccagccgttgaaactgatgatcttgagtgggcgagaagtatgcggaatgcgtggtgtagcggtgaaatgcatagatatcacgcagaactccgattgcgaaggcagcataccggcgcccgactgacgctgaagcacgaaagcgtgggtatcgaacaggattagataccctggtagtccacgcagtaaacgatgaatactaattgtgtgctccgaatgaggagtgcgtgatacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcaggagggatgtttttgaaaggaggcagctctacggagtctcctgcgaggtgctgcatggttgtcgtcagctcgtgccgtgaggtgtcggcttaagtgccataacgagcgcaacccctaccgccagttgccaacgggtaaagccgggaactctggcgggactgccggcgcaagctgtgaggaaggcggggatgacgtcaaatcagcacggcccttacgtccggggcgacacacgtgttacaatggcaggtacagcgggaagccacttggcgacaaggcgcggaacccgaaaacctgtctcagttcggattggagtctgcaacccgactccatgaagctggattcgctagtaatcgcgcatcagccacggcgcggtgaatacgttcccgggccttgcactcaccgcccgtca

SEQ ID NO: 123 - DNA, 1393 bp, Artificial Sequence
  Synthetic Polynucleotide
tagtggcgaacgggtgagtaacgcgtgggcaacctgccctctagatggggacaacatcccgaaaggggtgctaataccgaatgtgacagcaatctcgcatgaggatgctgtgaaagatggcctctatttataagctatcactagaggatgggcctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcaggttgtgaataatgacttgtaatgacggtagtaaacgcaataagccacggctaactacgtgccagcagccgcggtaatacgtaggtggcgagcgttgtccggaattattgggcgtaaagagcatgtaggcggttttttaagtctggagtgaaaatgcggggtctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggagtgttatcgaccccttctgtgtccggagtttaacgcaataagtaccccgtcctgggagtacgtcagcaaggatgaaactccaaggaattgaccggcggcccgcacaagcggtggagtatgtagtttaatttgacgcaacgcgaagaaccttaccaaggcttgacattgaatgaccgcttcagagatgaagctttcccttcggggacatgaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcggcaacagagggaagcgaagccgtgaggcagagcaaaccccagaaacccgatctcagttcggattgcaggctgcaactcgcctgcatgaagtcggaatcgctagtaatcgcaggtcagtcatactgcggtgaatacgttcccgggtcctgttacacaccgtcccgtcacaccacgaaagttggttaacacccgaagtccggtggggttaaccgtaaggag

SEQ ID NO: 124 - DNA, 1495 bp, Artificial Sequence
  Synthetic Polynucleotide
  misc_feature (13)..(14): n is a, c, g, or t
  misc_feature (21)..(21): n is a, c, g, or t
ttagagtttgatnntggctcnggatgaacgctagcggcaggcttaacacatgcaagtcggacggcagcgggggtgagagcttgctctcactgccggcgagtggcgcacgggtgagtaacacgtatgcaacctgcccttgtcagggggacaacccgccgaaaggcgggctaagcccgcgtatatcccgggggggcatccctccgggaggaaaggagcgatccggacaaggatgggcatgcggcgcattagttagtcggcggggtgacggcccaccgagacgacgatgcgtaggggttctgagaggaaggccccccacactggtactgagacacggaccagactcctacgggaggcagcagtgaggaatattggtcaatggccgagaggctgaaccagccaagccgcgtgagggaggaaggtacagagtatcgtaaacctcttttgtcggggaacaaaatcggggacgtgtccccgactgcgtgtacccgaagaaaaagcatcggctaactccgtgccagcagccgcggtaatacggaggatgcgagcgttatccggatttattgggtttaaagggtgcgcaggcggtctgttaagtcagcggtcaaagcccggggctcaaccccggcccgccgttgaaactggcagactcgagttggagagaagtatgcggaatgcgcggtgtagcggtgaaatgcatagatatcgcgcagaactccgattgcgaaggcagcataccggctccacactgacgctcaggcacgaaagcgtgggtatcgaacaggattagataccctggtagtccacgcagtaaacgatgaatgctggctgtccggggggctttacccctgggtggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacgggagatggcgcaggcagagacgcctgtttccttcgggacatcttccgaggtgctgcatggttgtcgtcagctcgtgccgtgaggtgtcggcttaagtgccataacgagcgcaacccccgcgggcagttgctaacaggtagcgctgaggactctgcccggactgccggcgcaagccgcgaggaaggcggggatgacgtcaaatcagcacggcccttacgtccggggcgacacacgtgttacaatggggggtacagcgggaagccaggcggtgacgccgcgcggaacccgaaatcccctctcagttcggatcggagtctgcaacccgactccgtgaagctggattcgctagtaatcgcgcatcagccatggcgcggtgaatacgttcccgggccttgtacacaccgcccgtcaagccatgggagccgagggcgcttgaagtgcgtcgccgtgaggcgcgccctagagcgaaatcggtgactggggctaagtcgtaacaaggta

SEQ ID NO: 125 - DNA, 1365 bp, Artificial Sequence
  Synthetic Polynucleotide
agagtttgatcctggctcaggatgaacgctggcggcgcgcctaacacatgcaagtcgaacggcacccatcttcggatggaagcgagtggcgaacggctgagtaacacgtggagaacctgccccctcccccgggatagccgcccgaaaggacgggtaataccggataccccggggggccgtatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctggaccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgatacaatggccggtacagaaggcagcaaccacgcaagtgcaagcaaatctcaaaaagccggtctcagttcggattgtgggctgcaacccgcccacatgaagttggaatcgctagtaatcgcaggtcagcatactgcggtgaatacgttcccgggccttgcactcaccgcccgtca

SEQ ID NO: 126 - DNA, 1411 bp, Artificial Sequence
  Synthetic Polynucleotide
agagtttgatcctggctcaggatgaacgctggcggcatgcctaacacatgcaagtcgaacggagattgcttcggtaatcttagtggcgaacgggtgagtaacgcgtaggcaacctgccctttagatggggacaacattccgaaaggggtgctaataccgaatgtgacggaagtatcgcatgacacttccgtgaaagatggcctctacatgtaagctatcgctaaaggatgggcctgcgtctgattagctagttggtgcggtaacggcgcaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgatgaagggattcgtcccgtaaagctctgttgtcaaggacgaatgtgcatactgcgaatagttgtatgtaatgacggtacttgacgaggaagccacggctaactacgtgccagcagccgcggtaatacgtaggtggcgagcgttgtccggaattattgggcgtaaagagcatgtaggcggttttttaagtccggagtgaaaatgcggggctcaaccccgtatggctctggatactgaaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgattgaaagacatagagatatgtccctctcttcggagacaagaaaacaggtggtgcatggctgtcgtcagctcgtgtcgtgagatgttgggttaagtcccgcaacgagcgcaacccctatcctatgttaccagcacgtgatagtggggactcataggagactgccaaggacaacttggaggaaggcggggatgacgtcaagtcatcatgctccttatgtcttgggctacacacgtactacaatggtcggcaacagagggaagcgaagccgcgaggcagagcaaaccccagaaacccgatctcagttcggattgcaggctgcaactcgcctgcatgaagtcggaatcgctagtaatcgcaggtcagcatactgcggtgaatacgttcccgggccttgcacacaccgcccgtca

SEQ ID NO: 127 - DNA, 1407 bp, Artificial Sequence
  Synthetic Polynucleotide
agagtttgatcctggctcaggacaaacgctggcggcatgcctaacacatgcaagtcgaacggggtttcttcggaaacctagtggcgaacgggtgagtaacgcgtaggcaacctgccccctagacggggacaacattccgaaaggagtgctaataccggatgtgaagcccctcccgcatgggaggggcctgaaagatggcctctatttataagctatcgctagaggatgggcctgcgtctgattagctagtaggtggggtaacggcctaactaggcgacgatcagtagccggtctgagaggatgaacggccacattgggactgagacacggcccagactcctacgggaggcagcagtggggaatcttccgcaatgggcgcaagcctgacggagcaatgccgcgtgagtgatgaagggattcgtcccgtaaagctctgttgtccatgacgaacggtgcgagggtgaacaatcctagcaagtgacggtagtggacgaggaagccacggctaactacgtgccagcagccgcggtaatacgtaggtggcgagcgttgtccggaattattgggcgtaaagagcatgtaggcggtcttttaagtccggagtgaaaatgcggggctcaaccccgtatggctccggatactgggaggcttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggaactaggtgtaggaggtatcgaccccttctgtgccggagttaacgcaataagttccccgcctggggagtacggccgcaaggttgaaactcaaaggaattgacgggggcccgcacaagcggtggattgtgtggattaattcgacgcaacgcgaagaaccttaccagggcttgacattgagtgacagtgctagagataacaccttcccttcggggacacgaaaacaggtggtgcatggctgtcgtcagctcgtgtcgtgagatgttgggttaagtcccgcaacgagcgcaacccctatcctatgttaccatcattcagttggggactcatgggagattgccagggacaacctggaggaaggcggggatgacgtcaagtcatcatgccccttatgtcctgggcttcacacgtaatacaatggccggcaacagagggaagcgtagccgcgaggcagagccaaccccagaaacccggtcccagttcggatcgcaggctgcaacccgcctgcgtgaagttggaatcgctagtaatcgcaggtcagcatactgcggtgaatacgttcccgggccttgcacacaccgcccgtca

SEQ ID NO: 128 - DNA, 1410 bp, Artificial Sequence
  Synthetic Polynucleotide
agagtttgatcctggctcaggacgaacgctggcggcatgcctaacacatgcaagtcgaacggagattacttcggtaatcttagtggcgaacgggtgagtaacgcgtgggcaacctgccctctagatggggacaacatcccgaaaggggtgctaataccgaatgtgacagcaatctcgcatgaggatgctgtgaaagatggcctctatttataagctatcgctagaggatgggcctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcccgacggagcaatgccgcgtgagtgatgaaggaattcgttccgtaaagctcttttgtttatgacgaatgtgcaggttgtgaataatgacttgtaatgacggtagtaaacgaataagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgaatgaccgcttcagagatgaagctttcccttcggggacatgaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtctagggcctcacacgtcatacaatggtcggaacagagggtagcgaaactgcgaagtggagccaatcccagaaaaccgatcgtagtccggattgcagtctgcaactcgactgcacgaagctggaatcgctagtaatcgcgaatcagaatgtcgcggtgaatacgttcccgggtcttgtacacaccgcccgtca

SEQ ID NO: 129 - DNA, 1405 bp, Artificial Sequence
  Synthetic Polynucleotide
agagtttgatcctggctcaggacgaacgctggcggcatgcctaacacatgcaagtcgaacggagattacttcggtaatcttagtggcgaacgggtgagtaacgcgtgggcaacctgccctctagatggggacaacatcccgaaaggggtgctaataccgaatgtgacagcaatctcgcatgaggatgctgtgaaagatggcctctatttataagctatcgctagaggatgggcctgcgtctgattagctagttggtggggtaacggccaaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcagattgtgaataatgatttgtaatgacggtagtaaacgaataagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtaactgacactgaggctcgaaagccaggggagcgaacgggattagataccccggtagtcctggccgtaaacgatgattactaggtgtggggggactgaccccttccgtgccggagttaacacaataagtaatccacctgggaagtacgatcgcaaggttgaaactcaaaggaattgacgggggcccgcacaagcagtggagtatgtggtttaattcgacgatacgcgaagaaccttaccaggtcttgacatccaactaacgaagcagagatgcattaggtgcctttcggggaaagttgagacaggtggtgcatggttgtcgtcagctcgtgtcgtgagatgttgggttaagtcccgcaacgagcgcaacccctacggttagttgctacgcaagagcactctaacaggactgccgttgataaaacggaggaaggtggggatgacgtcaaatcatcatgccctttatgacctgggctacacacgtactacaatggccgctaacagagggttacaatggagcgatccggagtcaatccctaaaagcggtcccagttcagattgcaggctgcaactcgcctgtatgaagttggaattgctagtaatcgcagatcagcatgctgcggtgaatacgttcccgggccttgtacacaccgcccgtca

SEQ ID NO: 130 - DNA, 1396 bp, Artificial Sequence
  Synthetic Polynucleotide
agagtttgatcctggctcaggatgaacgctagcgacaggcctaacacatgcaagtcgaggggcatcggggatgtagcaatacatccgccggcgaccggcgcacgggtgagtaacacgtatgcaaccaacccgtaacagggagataacccggggaaatccggactaatatcccatggtatcacgtttccgcatggaactgtgattaaatttacgaaggttacggacgggcatgcgctccattagccagttggcggggtaacggcccaccaaagccacgatggataggggttctgagaggaaggtcccccacattggaactgagacacggtccaaactcctacgggaggcagcagtgaggaatattggtcaatggacggaagtctgaaccagccaagtcgcgtgaaggaagacagtcggtaagatcgtaaacttcttttatcagggagtaaccgccgctacgcgtagcggcctgcaagtacctgaagaaaaagcatcggctaactccgtgccagcagccgcggtaatacggaggatgcgagcgttatccggatttattgggtttaaagggtgcgtaggcgggatgccaagtcagcggtgaaaactccgggctcaacccggaccccgccgttgaaactggtaacctagagagtattggaagtaagcggaatgcgtggtgtagcggtgaaatgcatagatatcacgcagaaccccgattgcgaaggcagcttactacactaccactgacgctgaagcacgaaagcgtgggtatcaaacaggattagataccctggtagtccacgcagtaaacgatgaatactaactgtttgcgatacacagtaagcggtactgcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacgggggactaccggtgaaagccggtatccagctatggccgccgtcgaggtgctgcatggttgtcgtcagctcgtgccgtgaggtgtcggcttaagtgccataacgagcgcaacccctatcgacagttactaacaagtagtgttgaggactctgtcgagactgccagcgcaagctgcgaggaaggcggggatgacgtcaaatcagcacggcccttacgtccggggcgacacacgtgttacaatggcaggaacagaaggcagcaacatagcaatatgaagccaatccccaaaccctgcctcagttcggattggagtctgcaacccgactccatgaagctggattcgctagtaatcgcgcatcagccatggcgcggtgaataaattcccgggccttgcacacaccgcccgtca

SEQ ID NO: 131 - DNA, 1392 bp, Artificial Sequence
  Synthetic Polynucleotide
agagtttgatcctggctcaggacgaacgctggcggcatgctttacacatgcaagtcgaacggcagcgcgggagcttgctcctggcggcgagtggcgcacgggtgagtaatacatcggaacgtgtccttgagtgggggataactgtccgaaaggacagctaataccgcatgagacctgagggtgaaagcgggggatcgcaagacctcgcgctcgaggagcggccgatgcccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggaagctcgaataaagctttctgctgacggtacctgaagaataagcaccggctaactacgtgccagcagccgcggtaatacgtagggtgcgagcgttaatcggaattactgggcgtaaagcgtgcgcaggcggttctgtaagatagatgtgaaatccccgggctcaacctgggaattgcatatatgactgcaggacttgagtttgtcagaggagggtggaattccaagtgtagcagtgagatgcgtagatatttggaagaacaccgatggcgaaggcagccctctgggacatgactgacgctcatgcacgaaagcgtggggagcaaacaggattagataccctggtagtccacgccctaaacgatgtctactagttgttggggactgaggtccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaatccctgagagattagggagtgcccgaaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggcggagcgaatcccagaaaaccgatcgtagtccggattgcagtctgcaactcgactgcatgaagtcggaatcgctagtaatcgcggatcagcatgccgcggtgaatacgttcccgggtcttgtacacaccgcccgtca

SEQ ID NO: 132 - DNA, 1393 bp, Artificial Sequence
  Synthetic Polynucleotide
agagtttgatcctggctcaggatgaacgctggcggcgtgcttaacacatgcaagtcgaacgaagcatttgcgacagattctttcgggatgaagatgcttatgactgagtggcggacgggtgagtaacgcgtgggtaacctgccttatacagggggatagcagttggaaacgactggtaataccgcataagcgcacggtatcgcatgatacagtgtgaaaaactgaggtggtataagatggacccgcgtctgattagctagttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcgcaagtcagaagtgaaagcccggggctcaaccccgggactgcttttgaaactgcggagctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgcttcggtgccgcagcaaacgcaataagtattccacctggggaatacgttcgcaagaatgaaactcaaaggaattgacggggacccgcacaagcggtggagcatgtggtttaattcgaagcaacgcgaagaaccttacctgctcttgacatcccattcgatagagggtaatgcctctagcccttcgggggaatggagacaggtggtgcatggttgtcgtcagctcgtgtcgtgagatgttgggttaagtcccgcaacgagcgcaacccctatcttcagtagccagcggtttggccgggcactctggggagactgccagggataacctggaggaaggcggggatgacgtcaaatcatcatgccccttatgatttgggctacacacgtgctacaatggcgtaaacaaagggaagcagacctgtgaaggcgagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtca

SEQ ID NO: 133 - DNA, 1394 bp, Artificial Sequence
  Synthetic Polynucleotide
agagtttgatcctggctcaggatgaacgctggcggcgtgcttaacacatgcaagtcgaacgaagcaccttattagattttcttcgggaatgaagatatggtgactgagtggcggacgggtgagtaacgcgtgggtaacctgcctcatacagggggatagcagttggaaacgactggtaataccgcataagcgcacggtatcgcatgatacagtgtgaaaaactccggtggtatgagatggacccgcgtctgattagctagttggtaaggtaacggcttaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagttattcgtaatgtaaagctctatcagcagggaagatagtgacggtacctgactaagaagctccggctaaatacgtgccagcagccgcggtaatacgtatggagcaagcgttatccggatttactgggtgtaaagggagtgtaggtggctgtgcaagtcagaagtgaaagcccggggctcaaccccgggactgcttttgaaactgtatagctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcgtatagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggtcttgacatcccgatgaccgactcttaaccgagtcttttcttcggaacatcggagacaggtggtgcatggttgtcgtcagctcgtgtcgtgagatgttgggttaagtcccgcaacgagcgcaacccctgtccttagtagccagcagttcggttgggcactctggggagactgccagggataacctggaggaaggtggggatgacgtcaaatcatcatgccccttatgatctgggctacacacgtgctacaatggtgataacaaagggaagcgaaactgcgaggtggagcaaatcccagaaaagtcatctcagttcggattgtagtctgcaactcgactacatgaagctggaatcgctagtaatcgcgaatcagaatgtcgcggtgaatacgttcccgggtcttgcacacaccgcccgtca

SEQ ID NO: 134 - DNA, 1345 bp, Artificial Sequence
  Synthetic Polynucleotide
gacgaacgctggcggcgtgcctaacacatgcaagtcgaacggagttaagagagcttgctcttttaacttattggcggacgggtgagtaacgcgtgagtaacctgcctttcacaggggaataacattctgaaaagaatgctaataccgcatgagatcgtagtatcgcatggtacagcgaccaaaggagcaatccgctgaaagatggactcgcgtccgattagctagttggtgagataaaggcccaccaagccgacgatcagtagccggactgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcaccagggaagacagtgacggtacctgactaataagctccggctaaatacgtgccagcagccgcggtaatacgtatggagcaagcgttatccggatttactgggtgtaaagggagtgtaggtggtatcacaagtcagaagtgaaagcccggggctcaaccccgggactgcttttgaaactgtggaactggagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacttggggagtacgttcgcaagaatgaaactcaaaggaattgacggggacccgcacaagcggtggagcatgtggtttaattcgaagcaacgcgaagaaccttaccaggtcttgacatcctgccaacgaggtagaggtacgttaggtgcccttcgcggaaagcagagacaggtggtgcatggttgtcgtcagctcgtgtcgtgagatgttgggttaagtctcgcaacgagcgcaacccctatcctcagtagccagcaggtaaagctgggcactctgtggagactgccagggataacctggaggaaggtggggatgatgtcaaatcatcatgccccttatgacttgggctacgacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtct

SEQ ID NO: 135 - DNA, 1413 bp, Artificial Sequence
  Synthetic Polynucleotide
agagtttgatcctggctcaggacgaacgctggcggcatgcctaacacatgcaagtcgaacggagaatcatttcggtgattcttagtggcgaacgggtgagtaacgcgtaggcaacctgccctttggatggggacaacattccgaaaggagtgctaataccgaatgtgacggttttctcgcatgagataatcgtgaaagatggcctctacatgtaagctatcgccaaaggatgggcctgcgtctgattagctagttggtggggtaacggctcaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgatgaaggttttcggaccgtaaagctcttttgtttatgacgaacgtgcctgctgtgaacaatggtgggtaatgacggtagtaaacgaataagccacggctaactacgtgccagcagccgcggtaatacgtaggtggcgagcgttgtccggaattattgggcgtaaagagcatgtaggcggtcctttaagtctggagtgaaaatgcggggctcaaccccgtatggctttggatactgggggacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgacccctcctgtgccggagttaacgcaataagtaccccgcctggggagtacgtcggcaacgatgaaactcaaaggaattgacgggggcccgcacaagcggtggagtatgtggtttaattcgacgcaacgcgaagaaccttaccaaggcttgacattgattgaccgctccagagatggagctttcccttcggggacatgaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcggcaacagagggaagcgaagccgcgaggcagagcaaaccccagaaacccgatctcagttcggatcgcaggctgcaacccgcctgcgtgaagtcggaatcgctagtaatcgcaggtcagcatactgcggtgaatacgttcccgggccttgtacacaccgcccgtca

SEQ ID NO: 136 - DNA, 1353 bp, Artificial Sequence
  Synthetic Polynucleotide
gatgaacgctggcggcgtgcttaacacatgcaagtcgagcgaagcgcttatgaaagattcttccgatgaattcatttgtgactgaacggcggacgggtgaataacgcgtgggtaacctgcctcatacagggggataacagttggaaaccactgctaataccgcataagcccacagtaccgcatggtaccgtgtgaaaaactccggtggtatgaaatggacccccctccgaatagctggttggtgaagtaacggcccaccaaggcgacgatcagtagccgacctgagagggtgaccggccacattgggactgagacacggcccagactcctacgggaggcagcagtggggaatattacacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttcccttcggggcagtggagacaggtggtgcatggttgtcgtcagctcgtgtcgtgagatgttgggttaagtcccgcaacgagcgcaacccttatccttagtagccagcagttcggctgggcactctagggagactgccagggataacctggaggaaggtggggatgacgtcaaatcatcatgccccttatgacttgggctacacacgtgctacaatggcgtaaacaaagtgaagcaaagctgtgaagccaagcaaatcacaaaaataacgtctcagttcggattgtagtctgcaactcgactacatgaagctggaatcgctagtaatcgcagatcagaatgccgcggtgaatacgttcccgggtct

SEQ ID NO: 137 - DNA, 1390 bp, Artificial Sequence
  Synthetic Polynucleotide
ttcgcccttagagtttgattctggctcaggacgaacgctggcggcgtgcctaacacatgcaagtcgaacggagatgctgaatttcggtttggtatcttagtggcgcacgggtgagtaacgcgtgaacaacttgaccttcagagggggataacagcgagaaatcggtgctaataccgcatgagaccacaattccacatggagaaggggtcaaaggagcaatccgctgaaggagaggttcgcgtcccattaggtagttggcgggataacagcccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcagaagacgaaggaagtgacggtattctgtgaggaagccccggctaactacgtgccagcagccgcggtaatacgtagggggcgagcgttgtccggaattactgggcgtaaagggtgcgtaggcggttgattaagttggatgtgaaatacccgggcttaacttggggggtgcattcaaaactggttaactagagtacaggagagggaagcggaattcctcgtgtagcggtgaaatgcgtagatattaggaggaacaccggtggcgaaggcggctttctggactgacactgacgctgaggcacgaaagcgtggggagcaaacaggattagataccctggtagtccacgctgtaaacgatgaatactaggtgtagggggtatgaactccctctgtgccgcagcaaacgcaataagtattccgcctggggagtacggccgcaaggttgaaactcaaaggaattgacgggggcccgcacaagcagcggagcatgtggtttaattcgacgcaacgcgaagaaccttaccaaggcttgacatctacttaaactcatggaaacatgaggtcccttcgggggaagtaagacaggtggtgcatggttgtcgtcagctcgtgtcgtgagatgttgggttaagtcccgcaacgagcgcaacccctgttgccagttaccagcaagtaaagttggggactctggtgagactgccggggacaactcggaggaaggtggggacgacgtcaaatcatcatgccccttatgtcttgggctacacacgtgctacaatgggtggtacagagggcagccaagtcgtgaggcggagctaatcccttaaagccattctcagttcggattgtaggctgaaactcgcctacatgaagctggagttactagtaatcgcagatcagaatgctgcggtgaatgcgttcccgggtcttgtacacaccgcccgtca

SEQ ID NO: 138 - DNA, 1353 bp, Artificial Sequence
  Synthetic Polynucleotide
gatgaacgctggcggcgtgcttaacacatgcaagtcgaacgaagcatttagaacggattatttcggtatgaagtttctttatgactgagcggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacgggggcccgcacaagcggtggagtatgtggtttaattcgaagcaacgcgaagaaccttaccagggcttgacatcctactaacgaagcagagatgcattaggtgcccttcggggaaagtagagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggcggggacgacgtcaaatcatcatgccccttatgtcctgggctacacacgtactacaatggtggtaaacagagggaagcaagaccgcgaggtggagcaaatccctaaaagccatcccagttcggattgcaggctgaaacccgcctgtatgaagttggaatcgctagtaatcgcggatcagcatgccgcggtgaatacgttcccgggcct

SEQ ID NO: 139 - DNA, 1366 bp, Artificial Sequence
  Synthetic Polynucleotide
agagtttgatcctggctcaggacgaacgctggcggcacgcttaacacatgcaagtcgaacggagaattttgagtttacttaaaattcttagtggcggacgggtgagtaacacgtgagcaacccgcctttgagagagggatagcttcgggaaactgatggtaatacctcataacgtatatttaaggcatcttagatataccaaagatttatcactcaaagatgggctcgcgtctgattagctagttggtgaggtaacggctcaccaaggcgacgatcagtagccggactgagaggttgaacggccacattgggactgagacacggcccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggtttcttaagtcagaggtgaaaggctacggctcaaccgtagtaagcctttgaaactgggaaacttgagtgcaggagaggagagtggaattcctagtgtagcggtgaaatgcgtagatattaggaggaacaccagttgcgaaggcggctctctgggctttaactgacgctgaggctcgaaagcgtggggagcaaacaggattagataccctggtagtccacgctgtaaacgatgattactaggtgtggggggactgaccccttccgtgccggagcaaacgcaataagtaatccacctggggagtacggccgcaaggttgaaactcaaaggaattgacgggggcccgcacaagcagtggagtatgtggtttaattcgaagcaacgcgaagaaccttaccaggtcttgacatcgagtgaataactaagagattagttagtccttcgggacacgaagacaggtggtgcatggttgtcgtcagctcgtgtcgtgagatgttgggttaagtcccgcaacgagcgcaacccttatcattagttgctacgcaagagcactctagtgagactgccgttgacaaaacggaggaaggtggggatgacgtcaaatcatcatgccccttatgacctgggctacacacgtactacaatgtcaattaacagagggcagcaatacagcgatgtaaagcgaaaccctaaaaattgtctcagttcggattgcaggctgcaactcgcctgcatgaagtcggaattgctagtaatcgcggatcagcatgccgcggtgaatacgttcccgggctttgtactcaccgcccgtca

SEQ ID NO: 140 - DNA, 1353 bp, Artificial Sequence
  Synthetic Polynucleotide
gatgaacgctggcggcgtgcttaacacatgcaagtcgaacgggaattactttattgaaacttcggtcgattttaatttaattctagtggcggacgggtgagtaacgcgtgggtaacctgccttatacagggggataacagtcagaaatggctgctaataccgcataagcgcacagtaccacatggtacagtgtgaaaaactccggtggtatgagatggacccgcgtctgattagctagttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttcccttcggggcagtggagacaggtggtgcatggttgtcgtcagctcgtgtcgtgagatgttgggttaagtcccgcaacgagcgcaacccttatccttagtagccagcagttcggctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtct

SEQ ID NO: 141 - DNA, 1386 bp, Artificial Sequence
  Synthetic Polynucleotide
agagtttgatcctggctcaggatgaacgctggcggcgtgcctaatacatgcaagtcgagcgagaagctcatgatggattcttcggatgacagattgagcggaaagcggcggacgggtgagtaacgcgtaggcaacctgcccttcacagagggatagcctcgggaaaccgggattaaaacctcataatgccgagacaagacatcttgattcggccaaagatttatcggtgaaggatgggcctgcgtctgattagttagttggtggggtaacggcctaccaaggcgacgatcagtagccgatctgagagggtgatcggccacattggaactgagacacggtccaaactcctacgggaggcagcagtggggaatattgcacaatgggggaaaccctgatgcagcaacgccgcgtgaaggaagaaggtcttcggatcgtaaacttctgtccttggggaagaaacaaatgacggtacccttggaggaagccccggctaactacgtgccagcagccgcggtaatacgtagggggcaagcgttatccggaattattgggcgtaaagagtacgtaggcggttctttaagcgcagggtttaaggctatggctcaaccatagttcgccctgtgaactgggggacttgagtatcggagaggaaagcggaattcctagtgtagcggtgaaatgcgtagatattaggaggaacaccagtggcgaaggcggctttctggacgaatactgacgctgaggtacgaaagcgtggggagcaaacaggattagataccctggtagtccacgccgtaaacgatgagcactaggtgtcggggccgcaaggtttcggtgccgcagttaacgcattaagtgctccgcctggggagtacgcacgcaagtgtgaaactcaaaggaattgacggggacccgcacaagcagcggagcatgtggtttaattcgaagcaacgcgaagaaccttaccagggcttgacatccttctgaccggaacttaaccgttcctttcttcggacagaagtgacaggtggtgcatggttgtcgtcagctcgtgtcgtgagatgttgggttaagtcccgcaacgagcgcaacccttgtcgttagttactaacattcagttgaggactctaatgagactgccgtggataacacggaggaaggtggggatgacgtcaaatcatcatgccccttatgtcctgggctacacacgtgctacaatggtcggtacaaagagaagcgagacagcgatgtggagcaaatctcaaaagccgatcccagttcggattgcaggctgcaactcgcctgcatgaagtcggagttgctagtaatcgtggatcagaatgccacggtgaatgcgttcccgggtcttgcactcaccgcccgtca

SEQ ID NO: 142 - DNA, 1370 bp, Artificial Sequence
  Synthetic Polynucleotide
gatgaacgctagcgacaggcctaacacatgcaagtcgaggggcagcggagaggtagcaatacctttgccggcgaccggcgcacgggtgagtaacacgtatgcaatccacctgtaacagggggataacccggagaaatccggactaataccccataatatgggcgttccgcatggagagctcattaaagagagcaattttggttacagacgagcatgcgctccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtacgctacgcgtagtgtattgcaagtatccgaagaaaaagcatcggctaactccgtgccagcagccgcggtaatacggaggatgcaagcgttatccggatttattgggtttaaagggtgcgtaggcggcacgccaagtcagcggtgaaatttccgggctcaacccggactgtgccgttgaaactggcgagctagagtacacaagaggcaggcggaatgcgtggtgtagcggtgaaatgcatagatatcacgcagaaccccgattgcgaaggcagcctgctagggtgaaacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatgtcggtgaaagccggcagctagtaatagtcacctgcgaggtgctgcatggttgtcgtcagctcgtgccgtgaggtgtcggcttaagtgccataacgagcgcaacccctatggacagttactaacgggtgaagccgaggactctgtctagactgccggcgcaagccgcgaggaaggtggggatgacgtcaaatcagcacggcccttacgtccggggcgacacacgtgttacaatggcaggtacagaaggctagcctagtcagcgaatgacgcgcgaatcccgaaaactctgtctcaagttcggattggagtctgcaaacccgactccatgagagctggaattcgctagtaatcgcgcttcagccatggcgcggtaaatacgttcccgggcct

SEQ ID NO: 143 - DNA, 1392 bp, Artificial Sequence
  Synthetic Polynucleotide
caggatgaacgctagcgacaggcttaacacatgcaagtcgaggggcagcgggggagaaagcttgctttctcacgccggcgaccggcgcacgggtgagtaacacgtatgcaacctggcccgtcacaggtggataaccggaagaaattccgactaatacagcataacactcttgagggacatctttcgggagtcaaaggaggcgactccggtgacggatgggcatgcggcgcattaggtagttggtagggcaacggcctaccaagccgacgatgcgtaggggttctgagaggaaggtcccccacattggaactgagacacggtccaaactcctacgggaggcagcagtgaggaatattggtcaatggccggaaggctgaaccagccaagtcgcgtgagggaataaggccctatgggtcgtaaacctcttttatcagggagcaaaggcgtccacgtgtggacgagaggagagtacctgaagaaaaagcatcggctaactccgtgccagcagccgcggtaatacggaggatgcgagcgttatccggatttattgggtttaaagggagcgtaggcggagtgtcaagtcagcggtaaaatttcggggctcaaccccgtcgtgccgttgaaactgacacccttgagtgagtgagaagtaagcggaatgcgtggtgtagcggtgaaatgcatagatatcacgcagaacgccgattgcgaaggcagcttaccggcgctcaactgacgctgaggcacgaaagtgcgggtatcgaacaggattagataccctggtagtccgcacagtaaacgatgaatgctagatgtccggggcgaatgagctttgggtgtcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgacacaggaacgtacctgaaagggttcggctctacggagcctgtgtcgaggtgctgcatggttgtcgtcagctcgtgccgtgaggtgtcggcttaagtgccataacgagcgcaacccccatcgacagttgctaacaggtcaggctgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtctcagttcggattggagtctgcaacccgactccatgaagctggattcgctagtaatcgcgcatcagccacggcgaggtgaatacgttcccgggccttgcacacaccgcccgtca

SEQ ID NO: 144 - DNA, 1364 bp, Artificial Sequence
  Synthetic Polynucleotide
gatgaacgctggcggcctgcttaacacatgccagtccaacgaagcatttgccacagatttcctcggaatgaaatttgcttatgactgaatggcggacgggtgaataacgcgtgggtaacctgcccttgtactgggggaatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggaggtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaatcaaaaggaattgacggggacccgcacaagcggtggagcatgtggtttaattcgaagcaaacgcgaagaaccttaccaagtcttgacatcctcttgaccggtcagtaatgtgacctttccttcgggacaagagtgacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacgcacgtgctacgatggcgtaaacgaaagtgaagcgaagtcgtgaggccaagcgaaatcgcgaaaaataacgtctcggttcggattgtagtctgcgaactcgactacataaagctggaaatcgctaggaatcgcggatcggaatgctgcggtaatacgtttcccgggtct

SEQ ID NO: 145 - DNA, 1407 bp, Artificial Sequence
  Synthetic Polynucleotide
agagtttgatcctggctcaggacgaacgctggcggcatgcctaacacatgcaagtcgaacggagaatagtttcgattattcttagtggcgaacgggtgagtaacgcgtaggcaacctgccctttggatggggacaacattccgaaaggagtgctaataccgaatgtgacggtcttatcgcatgatttgaccgtgaaagatggcctctacatgtaagctatcgccaaaggatgggcctgcgtctgattagctagttggtggggtaacggctcaccaaggcgacgatcagtagccggtctgagaggatgaacggccacattgggactgagacacggcccagactcctacgggaggcagtagtggggaatctttcgcaatgggcgaaagcctgacggagcaatgccgcatgagtgatgaaggttttcggaccgtaaagctcttttgtttatgacgaacgtgcttgatgtgaataatgttgagtaatgacggtagtaaacgaataagccacggctaactacgtgccagcagccgcggtaatacgtaggtggcgagcgttgtccggaattattgggcgtaaagagcatgtaggcggtcttttaagtccggagtgaaaatgcggggctcaaccccgtatggctttggatactgggagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgacccctcctgtgccggagttaacacaataagtattccacctggggagtacgaccgcaaggttgaaactcaaaggaattgacgggggcccgcacaagcagtggagtatgtggtttaattcgaagcaacgcgaagaaccttaccaggacttgacatcctactaacgaagtagagatacattaggtgcccttcggggaaagtagagacaggtggtgcatggttgtcgtcagctcgtgtcgtgagatgttgggttaagtcccgcaacgagcgcaacccttacggttagttgctacgcaagagcactctagccggactgccgttgacaaaacggaggaaggtggggacgacgtcaaatcatcatgccccttatgtcctgggctacacacgtactacaatggcggtaacagagggaggcaatacagcgatgtggagcaaatccctaaaagccgccccagttcagattgcaggctgaaactcgcctgcatgaagtcggaattgctagtaatcgcggatcagcatgccgcggtgaatacgttcccgggccttgcacacaccgcccgtca

SEQ ID NO: 146 - DNA, 1384 bp, Artificial Sequence
  Synthetic Polynucleotide
agagtttgatcctggctcaggataaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggctcaccaaggcgacgatccatagccggcctgagagggtgaacggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttattcggatttactgggtgtaaagggagtgtaggtggcatcgcaagtcagaagtgaaagcccggggctcaaccccgggactgcttttgaaactgcggagctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacaaaagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctgatcttgacatcccgctgaccgtcctttaatcgggattttccttcgggacagcggagacaggtggtgcatggttgtcgtcagctcgtgtcgtgagatgttgggttaagtcccgcaacgagcgcaacccctattgttagttgctacgaaagagcactctagcgagactgccgttgacagaacggaggaaggcggggacgacgtcaaatcatcatgccccttatgtcctgggctacacacgtaatacaatggcggtcaacagagggaagcaagagagcgatctggagcaaatccctaaaagccgtctcagttcggattgtaggctgcaactcgcctgcatgaagctggaattgctagtaatcgcggatcagcaagccgcggtgaatacgttcccgggccttgtacacaccgcccgtca

SEQ ID NO: 147 - DNA, 1370 bp, Artificial Sequence
  Synthetic Polynucleotide
agagtttgatcctggctcagattgaacgctggcggcaggcttaatacatgcaagtcgaacggtaacagcagaaaagcttgcttttttggctgacgagtggcggacgggtgagtaatacctaggaaactgcctaaacgagggggataacatttggaaacgagtgctaataccgcataatactgagaagtcaaaggttggtttaccaatcgcgtttagatgtgcctaggagggattagctagttggtggggtaaaggcctaccaaggcgatgatctctagctggtctgagaggatgaccagccacactggaactgagacacggtccagactcctacgggaggcagcagtagggaatattgcacaatgggggaaaccctgatgcagcaacgccgcgtgaaggaagaaggcctttgggtcgtaaacttctgttctaagggaagatagtgacggtaccttaggagcaagtcccggctaactacgtgccagcagccgcggtaatacgtagggggcgagcgttatccggaattattgggcgtaaagagtgcgtaggtggttacctaagcaaggggtataaggcaatggcttaaccattgttcgccccttgaactgggctacttgagtgcaggagaggaaagcggaattcctagtgtagcggtgaaatgcgtagatattaggaggaacaccagtggcgaaggcggctttctggactgtaactgacactgaggcacgaaagcgtggggagcaaacaggattagataccctggtagtccacgccgtaaacgatgatcatttggtttttggggtccgcaagattttggtgccgcagttaacgcaataagtgctcagcctggggaggtacgtacgcaaggtatgaaactcaagggaattgtcggggggcccgcacaagcagtggagtatgtggtttaattcgaagcaacgcgaagaaccttaccaggtcttgacatcgtatgcatagtctagagatagatgaagtctcttcggagacatatagacaggtggtgcatggttgtcgtcagctcgtgtcgtgagatgttgggttaagtcccgcaacgagcgcaacccttattgctagttactacgaaagaggactctagcgagactgccgttgacaaaacggaggaaggtggggatgacgtcaaatcatcatgccccttatgacctgggcaacacacgtactacaatggctgtaaacaaagtgaaccgaaaccgcgaggtagaggaaaccacaaaaagcagtctcagttcggattgtaggctgcaaatagcctacatgaagccggaattgctagtaatcgcggatcagcatgccgcggtgaatacgttcccgggccttgtaaaagccgcccgtca

SEQ ID NO: 148 - DNA, 1391 bp, Artificial Sequence
  Synthetic Polynucleotide
agagtttgatcctggctcaggacgaacgctggcggcgtgcttaacacatgcaagtcgaacgaagcattttgaaggaattcttcggaaggaattcaacttgacttagtggcggacgggtgagtaacgcgtgagcaacctgcctacaagagggggacaacagttggaaacgactgctaataccgcataagaccacgctatcgcatggtagagaggtcaaagatttatcgcttgtagatgggctcgcgtctgattagctggttggtgaggtaatggctcaccaaggcaacgatcagtagccgacctgagagggtgatcggccacactggaactgagacacggtccagactcctacgggaggcagcagtggggaatattgggcaatgggggcaaccctgacccagcaacgccgcgtgagggaagaaggttttcggattgtaaacctctgtccttggggacgaagaagtgacggtacccaaggaggaagctccggctaactacgtgccagcagccgcggtaatacgtagggagcgagcgttgtccggaattactgggcgtaaagggtgcgtaggcggtttggtaagtcagatgtgaaatacccgggcttaacccgggggctgcatctgatactgtcagacttgagtgcaggagaggaaagcggaattcctagtgtagcggtgaaatgcgtagatattaggaggaacaccagtggcgaaggcggctttctggactgtaactgacgctgaggcacgaaagcgtggggagcaaacaggattagataccctggtagtccacgccgtaaacgatggatactaggtgtaggcatcataagatgtctgtgccgcagcaaacgcattaagtatcccgcctggggagtacgaccgcaaggttgaaactcaaaggaattgacgggggcccgcacaggcagcggagcatgttgtttaatttgaagcaacgcgaagaaccttaccatgtcttgacatcgatctaatcctctagagatagagagtgccttcgggcaagagaagacaggtggtgcatggttgtcgtcagctcgtgtcgtgagatgttgggttaggtcccgcaacgagcgcaacccttatggtcagttactaacaagtaatggtgaggactctgacaagactgccggggacaactcggaggaaggtggggaggacgtcaaatcatcatgccccttatgacatgggctacaaacgtgctacaatggtggttacaaagaggagcgagcgtgtaagcgtaagcggatctcaaaaaagccatctcagttcggattgtgggctgcaacccgcccacatgaagttggagttgctagtaatcgcggatcagaatgccgcggtgaatacgttcccgggccttgcacacaccgcccgtca

SEQ ID NO: 149 - DNA, 1356 bp, Artificial Sequence
  Synthetic Polynucleotide
gatgaacgctagctacaggcttaacacatgcaagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacggtatcgcatgatacagtgtgaaaaactccggtggtatgagatggacccgcgtctgattagctggttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgacggcggcttgctggactgtaactgacactgaggctcgaaagcgtggggagcaaacaggattagataccctggtagtccacgccgtaaacgatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttcccttcggggcagtggagacaggtggtgcatggttgtcgtcagctcgtgtcgtgagatgttgggttaagtcccgcaacgagcgcaacccttatccttagtagccagcatttcaggtgggcactctagggagactgccagggataacctggaggaaggtgggatgacgtcaaatcatcatgccccttatgacttgggctacacacgtgctacaatggcgtaaacaaagtgaagcaaagctgtgaagccaagcaaatcacaaaaaataacgtctcagttcggattgtagtctgcaactcgactacatgaaagctggaaatcgctagtaatcgcagatcagaaatgctgcggtgaaatacgttcccggg

SEQ ID NO: 150 - DNA, 1339 bp, Artificial Sequence
  Synthetic Polynucleotide
gacgaacgctggcggcgcgcctaacacatgcaagtcgaacggagtcaagaggagcttgcttttcttgacttagtggcgaacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctcgctggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgacctttccttcgggacaagagtgacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcggatcagaatgccgcggtgaatacgttcccgggtct

SEQ ID NO: 151 - DNA, 1390 bp, Artificial Sequence
  Synthetic Polynucleotide
ttcgcccttagagtttgatcctggctcaggacgaacgctggcggcgtgcctaacacatgcaagtcgaacggagatgtttatttcggtagatatcttagtggcgcacgggtgagtaacgcgtgaataacctgacccgaagagggggataacacctggaaacaagtgctaataccgcataagaccacggaccggcatcggtcagaggtcaaaggaggaatccgctttgggaggggttcgcgtcccattaggtagttggtgaggtaacggtccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcaggggacgaaggaagtgacggtaccctgtaagaaagccccggctaactacgtgccagcagccgcggtaatacgtagggggcgagcgttgtccggaattactgggcgtaaagggagcgtaggcggtcgattaagttagatgtgaaacccccgggcttaacttggggactgcatctaatactggttgacttagagtacaggagagggaagcggaattcctagtgtagcggtgaaatgcgtagatattaggaggaacaccagtggcgaagccggctttctggactgacactgacgctgaggctcgaaagcgtggggagcaaacaggattagataccctggtagtccacgctgtaaacgatgaatactaggtgtagggggtatcaactccctcttgtgccgcagcaaacgcaataagtattccgcctggggagtacggccgcaaggttgaaactcaaaggaattgacgggggcccgcacaagcagcggagcatgtggtttaattcgacgcaacgcgaagaaccttaccaaggcttgacatctacttaaagtcatggaaacatgatgtctcttcggaggaagtaagacaggtggtgcatggttgtcgtcagctcgtgtcgtgagatgttgggttaagtcccgcaacgagcgcaacccctgttgccagttaccagcacgtaaaggtggggactctggtaagactgccggggacaactcggaggaaggtggggacgacgtcaaatcatcatgccccttatgtcttgggctacacacgtgctacaatggctataacaaagggaagcgaccccgtaaggggaagcggatctcagaaaagcagtctcagttcggattgtgggctgcaacccgcccacatgaagttggagttgctagtaatcgcggatcagcatgccgcggtgaatacgttcccgggccttgcactcaccgcccgtca

SEQ ID NO: 152 - DNA, 1410 bp, Artificial Sequence
  Synthetic Polynucleotide
agagtttgatcctggctcaggatgaatgctggcggcgtgcctaacacatgcaagtcgagcgagaattccttaactgattctccggatgattttaaggaaggaaagcggcggacgggtgagtaacgcgtaggcaacctgcctctcacagagggatagccactggaaacggtgattaaaacctcataacgccactccgggacatcccggaatggccaaagatttatcggtgagagatgggcctgcgtctgattagctggttggcggggtaacggcccaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggccttcgggtcgtaaacttctgttataagggaagaacgactttagtaggaaatggctaaagtgtgacggtaccttatgagaaagccacggctaactacgtgccagcagccgcggtaatacgtaggtggcaagcgttatccggaattattgggcgtaaagagcgcgcaggtggttgattaagtctgatgtgaaagcccacggcttaaccgtggagggtcattggaaactggtcgacttgagtgcagaagagggaagtggaattccatgtgtagcggtgaaatgcgtagagatatggaggaacaccagtggcgaaggcggcttcctggtctgcaactgacactgaggcgcgaaagcgtggggagcaaacaggattagataccctggtagtccacgccgtaaacgatgagcactaggtgtcggggtcgcaagacttcggtgccgcagttaacgcaataagtgctccgcctggggagtacgtacgcaagtatgaaactcaaaggaattgacggggacccgcacaagcagcggagcatgtggtttaattcgaagcaacgcgaagaaccttaccagggcttgacatccctctgacaggtccttaaccggacccttcttcggacagaggagacaggtggtgcatggttgtcgtcagctcgtgtcgtgagatgttgggttaagtcccgcaacgagcgcaacccttgctgttagttgccatcattaagttgggcactctaacgggactgccggggataactcggaggaaggtggggatgacgtcaaatcatcatgccccttatgttctgggctacacacgtgctacaatggtggttacaaagaggagcgagcatgcaaatgtaagcggatctcaaaaaagccatcccagttcggattgtgggctgcaacccgcccacatgaagttggagttgctagtaatcgcggatcagcatgccgcggtgaatacgttcccgggccttgcacacaccgcccgtca

SEQ ID NO: 153 - DNA, 1396 bp, Artificial Sequence
  Synthetic Polynucleotide
agagtttgatcctggctcaggatgaacgctggcggcgtgcttaacacatgcaagtcgaacgaagcatttacgacagatttcttcggaatgaagttgtttatgactgagtggcggacgggtgagtaacgcgtgggtaacctgcctcatacagggggatagcagctggaaacggctggtaataccgcacaagcgcacagtatcgcatgatatagtgtgaaaaactccggtggtatgagatggacccgcgtctgattagctagttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcgcaagtcagaagtgaaagcccggggctcaaccccgggactgcttttgaaactgcggagctagagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacggccgcaaggttgaaactcaaaggaattgacgggagcccgcacaagcagtggagtatgtggtttaattcgacgcaacgcgaaaaaccttaccaaggattgacatccacggaatcggacgtaatggtctgagtgcctcttcggaggaatcgtgagacaggtggtgcatggttgtcgtcagctcgtgtcgtgagatgttgggttaagtcccgcaacgagcgcaacccttatccttagtagccagcagtaagatgggcactctagggagactgccagggataacctggaggaaggtggggatgacgtcaaatcatcatgccccttatgacttgggctacacacgtgctacaatggcgtaaacaaagtgacgcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgcacacaccgcccgtca

SEQ ID NO: 154 - DNA, 1386 bp, Artificial Sequence
  Synthetic Polynucleotide
ttcgcccttagagtttgatcctggctcaggatgaacgctggcggcgtgcttaacacatgcaagtcgagcgagaaaagttcttcggagcttttctagcggcggacgggtgagtaacacgtgggcaacctgcctcatagaggggaatagccttccgaaaggaaggttaataccgcataacattgttgaaaggcatcttttaacaatcaaaggagcaatccgctatgagatgggcccgcggcgcattagctagttggtgaggtaacggctcaccaaggcgacgatgcgtagccgacctgagtgggtgatcggccacattggaactgagacacggtccagactcctacgggaggcagcagtagggaatattgggcaatgggcgcaagcctgacccagcaacgccgcgtgagggaagaaggttttcggattgtaaacctctgtcctatgtgacgaaggaagtgacggtagcataggaggaagccccggctaactacgtgccagcagccgcggtaatacgtagggggcgagcgttgtccggaattactgggcgtaaagggtgcgtaggcggtttggtaagttggatgtgaaatacccgggcttaacttgggggctgcatccaatactgtcggacttgagtgcaggagaggaaagcggaattcctagtgtagcggtgaaatgcgtagatattaggaggaacaccggtggcgaaggcggctttctggactgtaactgacgctgaggcacgaaagcgtggggagcaaacaggattagataccctggtagtccacgccgtgaacgatgaatactaggtgtagggggtatagactccctctgtgccgcagcaaacgcaataagtattccgcctggggagtacggccgcaaggttgaaactcaaaggaattgacgggggcccgcacaagcagcggagcatgtggtttaattcgacgcaacgcgaaaaaccttaccaagacttgacatcctactaaactcatggaaacatgaggtgacttcggtcgagtagagacaggtggtgcatggttgtcgtcagctcgtgtcgtgagatgttgggttaagtcccgcaacgagcgcaacccctgttgccggttaccagcgagtaaagtcggggactccggtgagactgccgaggacaactcggaggaaggtggggacgacgtcaaatcatcatgccccttacgtcttgggctacacacgtgctacaatggctgtaacaaagggaagcgacagcgtaagctgaagcggatctcgaaaaggcagtcccagttcggattgtgggctgcaacccgcccacatgaagtcggagttgctagtaatcgcggatcagcatgccgcggtgaatacgttcccgggccttgcactcaccgcccgtca

SEQ ID NO: 155 - DNA, 1365 bp, Artificial Sequence
  Synthetic Polynucleotide
agagtttgatcctggctcaggatgaacgctggcggcgcgcctaacacatgcaagtcgaacggcacccaccctcgggtggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatcaccgtgagccggcggagacgccggggccgaaaggagcggtgacaggtggtgcatggctgtcgtcagctcgtgtcgtgagatgttgggttaagtcccgcaacgagcgcaacccccgccgtatgttgccatcgggtaatgccgggcactcgtacgggaccgccggagccaatccggaggaaggcggggacgacgtcaagtcatcatgcccctcatgccctgggctgcacacgtgctacaatggccggtacaacgggccgccacgccgcgaggcggagcgaatccctcaaagccggccccagttcggatcgcaggctgcaacccgcctgcgtgaagccggagttgctagtaatcgcggatcagcatgccgcggtgaatacgttcccgggccttgcactcaccgcccgtca

SEQ ID NO: 156 - DNA, 1388 bp, Artificial Sequence
  Synthetic Polynucleotide
ttcgcccttagagtttgatcctggctcaggacgaacgctggcggcgtgcctaacacatgcaagtcgaacggagatgtttatttcggtagacatcttagtggcgcacgggtgagtaacgcgtgaataacctgacccgaagagggggataacacctggaaacaagtgctaataccgcataagaccacggaccggcatcggtcagaggtcaaaggaggaatccgctttgggaggggttcgcgtcccattaggtagttggtgaggtaacggcccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcaggggacgaaggaagtgacggtaccctgtaagaaagccccggctaactacgtgccagcagccgcggtaatacgtagggggcgagcgttgtccggaattactgggcgtaaagggagcgtaggcggtcgattaagttagatgtgaaacccccgggcttaacttggggactgcatctaatactggttgacttagagtacaggagagggaagcggaattcctagtgtagcggtgaaatgcgtagagattaggaagaacaccagtggcgaaggcgattctctggactgtaactgacgctgaggctcgaaagcgtggggagcaaacaggattagataccctggtagtccacgccgtaaacgatgaatactaggtgtaggggccccaagcctctgtgccgccgctaacgcattaagtattccgcctggggagtacggtcgcaagattaaaactcaaaggaattgacgggggcccgcacaagcagcggagcatgtggtttaattcgacgcaacgcgaagaaccttaccaggtcttgacatccacttaaacttacagagatgtaaggtgtgcttgcacaaagtgagacaggtggtgcatggttgtcgtcagctcgtgtcgtgagatgttgggttaagtcccgcaacgagcgcaacccttatcttcagttactaacgcgtaaaggtgaggactctgaagagactgccggggacaactcggaggaaggtggggacgacgtcaaatcatcatgccccttatgacctgggctacacacgtgctacaatggccacgacagagagaagcgaaatcgcaaggtagagcggaactcaaaaaagtggtcccagttcggattgtgggctgcaacccgcccacatgaagtcggagttgctagtaatcgcggatcagcatgccgcggtgaatacgttcccgggccccttgcacacaccgcccgtca

SEQ ID NO: 157 - DNA, 1356 bp, Artificial Sequence
  Synthetic Polynucleotide
gatgaacgctggcggcgtgcttaacacacgcaagtcgaacgaaagcatttaagacagattacttcggtttcgaagtcttttatgactgagcggcggacgggtgagtaacgcgtgggtaacctgcctcatacagggggatagcagctggaaacggctggtaataccgcataagcgcacggtatcgcatgatacagtgtgaaaaactccggtggtatgagatggacccgcgtctgattagctggttggtggggtaatggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagtccgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggccagtaatgtgacctttccttcgggacaagagagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtct

SEQ ID NO: 158 - DNA, 1394 bp, Artificial Sequence
  Synthetic Polynucleotide
agagtttgatcctggctcagattgaacgctggcggcatgctttacacatgcaagtcgaacggcagcacagggagcttgctcccgggtggcgagtggcgcacgggtgagtaatacatcggaacgtgtcctatagtgggggataactagtcgaaagactagctaataccgcatgagacctgagggtgaaagcaggggatcgcaagaccttgcgctattggagcggccgatgcccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaaggactgtgctaataccacggtctgctgacggtacctgaagaataagcaccggctaactacgtgccagcagccgcggtaatacgtagggtgcaagcgttaatcggaattactgggcgtagagcgtgcgcaggcggttctgtaagacagatgtgaaatccccgggcttaacctgggaattgcatttgtgactgcaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacaggattagataccctggtagtccacgccctaaacgatgtctactggttgttggggttttttaaccctggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaatcctgaagagattcgggagtgcccgcaagggaatctggacacaggtgctgcatggctgtcgtcagctcgtgtcgtgagatgttgggttaagtcccgcaacgagcgcaacccttgtcactagttgctacgcaagagcactctagtgagactgccggtgacaaaccggaggaaggtggggaggacgtcaagtcctcatggcccttatggctagggcctcacacgtcatacaatggcgtaaacaaagagaagcgaacctgtgaaggtgggcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtca

SEQ ID NO: 159 - DNA, 1370 bp, Artificial Sequence
  Synthetic Polynucleotide
agagtttgatcctggctcaggacgaacgctggcggcgtgcttaatacatgcaagtcgaacggaagttatgttttcggatgtaactttagtggcgaacgggtgagtaacgcgtgaacaacctgactcagagtgggggataacaacgggaaactgttgctaataccgcataagaccacgaccccgcatggggatggggtcaaagatttatcgctttgagaggggttcgcgtcccattaggtagttggaggggtaacggcccaccaagccgacgatgggtagccgagctgagaggctgatcggccacactggaactgagacacggtccagactcctacgggaggcagcagtagggaatattgggcaatgggcgcaagcctgacccagcaacgccgcgtgagggaagaaggttttcggattgtaaacctctgtcctatgtgacgaaggaagtgacggtagcataggaggaagccccggctaactacgtgccagcagccgcggtaatacgtagggggcgagcgttgtccggaattactgggcgtaaagggtgcgtaggcggtctggtaagttggatgtgaaatacccgggcttaacttgggtgctgcatccaatactgtcggacttgagtgcaggagaggaaagcggaattcctagtgtagcggtgaaatgcgtagatattaggaggaacaccagtggcgaargcggctttctggactgtaactgacgctgagcacgaaagcgtggggagcaaacaggattagataccctggtagtccacgccgtaacgatgaatactaggtgtagggggtatagactccctctgtgccgcagcaaacgcaataagtattccgcctggggagtacggccgcaaggttgaaactcaaaggaattgacgggggcccgcacaagcagcggagcatgtggtttaattcgacgcaacgcgaagaaccttaccaaggcttgacatcctgctaaactcatggaaacatgaggtgacttcggtcgagcagagacaggtggtgcatggttgtcgtcagctcgtgtcgtgagatgttgggttaagtcccgcaacgagcgcaacccctgttgccagttaccagcgagtaaagtcggggactctggtgagactgccggggacaactcggaggaaggtggggacgacgtcaaatcatcatgccccttacgtcttgggctacacacgtgctacaatggctgtaacaaagggaagcgacagcgtaagctgaagcggatctcataaaggcagtcccagttcggattgtgggctgcaacccgcccacatgaagtcggagttgctagtaatcgcggatcagcatgccgcggtgaatacgttcccgggccttgtacacaccgcc

SEQ ID NO: 160 - DNA, 1356 bp, Artificial Sequence
  Synthetic Polynucleotide
gatgaacgctggcggcgtgcttaacacatgcaagtcgaacgaagcatttaagacggattacttcggtttgaagtcttttatgactgagtggcggacgggtgagtaacgcgtgggtaacctgcctcatacagggggatagcagctggaaacggctgataataccacataagcgcacagtaccacatggtacagtgtgaaaaactccggtggtatgagatggacccgcgtctgattagctagttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgctgtaaacgatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccctattcttagtagccagcatataaggtgggcactctaggaagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaaatcgctagtaatcgcgaaatcagaaatgtcgcggtgaaatacgttcccggg

SEQ ID NO: 161 - DNA, 1354 bp, Artificial Sequence
  Synthetic Polynucleotide
gatgaacgctggcggcgtgcttaacacatgcaagtcgaacgaagcatttagaacagattatttcggtatgaagttctttatgactgagcggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtataaagggagtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaaaaaccttaccaagtcttgacatcctgatgacggttccttaaccggaacttttcttcggaacatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcaaacctgtgaaggcgagcaaacctcaaaaaggctgtctcagttcggattgtagtctgcaactcgactacatgaagctggaatcgctagtaatcgcagatcagcatgctgcggtgaatacgttcccgggtct

SEQ ID NO: 162 - DNA, 1411 bp, Artificial Sequence
  Synthetic Polynucleotide
agagtttgatcctggctcaggacgaacgctggcggcatgcctaacacatgcaagtcgaacggagattacttcgataatcttagtggcgaacgggtgagtaacgcgtaggcaacctgccctctagatggggacaacatcccgaaaggggtgctaataccgaatgtgacaagttttccgcatggaagacttgtgaaagatggcctctatttataagctatcgctagaggatgggcctgcgtctgattagctagttggtggggtaacggctcaccaaggcgatgatcagtagccgatctgagaggatgaacggccacattgggagtgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcgagttgtgaataatgacttgtaatgacggtagtaaacgaataagccacggctaactacgtgccagcagccgcggtaatacgtaggtggcgagcgttgtccggaattattgggcgtaaagagcatgtaggcggtcgtttaagtctggagtgaaaatgcggggctcaaccccgtatagctctggatactggaggacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcttggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgaatgaccgcttcagagatgaggctttcccttcggggacatgaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcgacaacagagggaagcaaagccgcgaggcagagcaaaccccagaaactcgatctcagttcggattgcaggctgcaactcgcctgcatgaagtcggaatcgctagtaatcgcaggtcagcatactgcggtgaatacgttcccgggccttgcactcaccgcccgtca

SEQ ID NO: 163 - DNA, 1355 bp, Artificial Sequence
  Synthetic Polynucleotide
gatgaacgctggcggcgtgcttaacacatgcaagtcgaacgaagcatttaaaacggattttttcggaatgaagttttttatgactgagtggcggacgggtgagtaacgcgtgggtaacctgcctcacacagggggatagcagttggaaacgactggtaataccgcataagcgcacagcttcgcatgaagcggtgtgaaaaactccggtggtgtgagatggactcgcgtctgattaggtagttggtgaggtaacggcccaccaagccgacgatcagtagccgacctgagagggtgaccggccacattgggactgagacacggcccagactcctacgggaggcagcagtggggaatattgcacaatggaggaaactctgatgcagcgacgccgcgtgagtgaagaagtatttcggtatgtaaagctctatcagcagggaagacagtgacggtacctgactaagaagctccggctaaatacgtgccagcagccgcggtaatacgtatggagcaagcgttatccggatttactgggtgtaaagggagtgtaggtggtatcacaagtcagaagtgaaagcccggggctcaaccccgggactgcttttgaaactgtggaactggagtgcaggagaggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcgggaggcattgcctttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccgatgacagagcatgtaatgtgctttctcttcggagcatcggtgacaggtggtgcatggttgtcgtcagctcgtgtcgtgagatgttgggttaagtcccgcaacgagcgcaacccctatcctcagtagccagcaggtaaagctgggcactctgtggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaacccgactacatgaagctggaatcgctagtaatcgcgaatcagaatgtcgcggtgaatacgttcccgggtct

SEQ ID NO: 164 - DNA, 1371 bp, Artificial Sequence
  Synthetic Polynucleotide
agagtttgatcctggctcaggacgaacgctggcggcgtgcctaacacatgcaagtcgaacggagtgaaacccttcgggatttcacttagtggcgaacgggtgagtaacgcgtgaggaacctgcctttcagtgggggacaacagttggaaacgactgctaataccgcataatgcttttggatcgcatgatttaaaagccaaagatttattgctgaaagatggcctcgcgtctgattagctagttggtggggtaacggctcaccaaggcgacgatcagtagccggtctgagaggatgaacggccacattgggactgagatacggcccagactcctacgggaggcagcagtggggaatattgggcaatgggggaaaccctgacccagcaacgccgcgtgaaggaagaaggccttcgggttgtaaacttcttttaccagggacgaaaaaagtgacggtacctggagaaaaagcaacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggccgcacaagcagtggattatgtggtttaattagaagcaacgcgaagaaccttaccagggcttgacatccaactaacgaagtagagatacattaggtgcccttcggggaaagttgagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcgtgggctacacacgtaatacaatggcgcacacagagggaagcaaaaccgcgaggtggagcaaatccctaaaaggcgtctcagttcggattgcagtctgcaacttgactgcatgaagtcggaattgctagtaatcgcggatcagcatgccgcggtgaatacgttcccggcccttgcactcaccgcccgtca

SEQ ID NO: 165 - DNA, 1394 bp, Artificial Sequence
  Synthetic Polynucleotide
agagtttgatcctggctcaggatgaacgctggcggcgtgcttaacacatgcaagtcgaacgaagcatatttatcagattccttcgggaagaagatttatatgactgagtggcggatgggtgagtaacgcgtgggtaacctgcctcacacagggggatagcagatggaaacggctgataataccgcataagcgcacagcttcgcatgaagcggtgtgaaaaactccggtggtgtgagatggacccgcgtctgattagcttgttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagacagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggggctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcccaaaagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacagagtatgtaatgtacttttccttcgggacagaggaggcaggtggtgcatggttgtcgtcagctcgtgtcgtgagatgttgggttaagtcccgcaacgagcgcaacccctatccttagtagccagcacgtaacggtgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacagaaataacgtctcagttcggattgtagtctgcaactcgactacatgaagctggaatcgctagtaatcgcgaatcagaatgtcgcggtgaatacgttaccgggtcttgcacacaccgcccgtca

SEQ ID NO: 166 - DNA, 1408 bp, Artificial Sequence
  Synthetic Polynucleotide
agagtttgatcctggctcaggatgaacgctagcgacaggcttaacacatgcaagtcgaggggcagcgggggagaaagcttgctttctcctgccggcgaccggcgcacgggtgagtaacacgtatgcaacctggccgtcacaggtggataaccggaagaaattccgactaatacagcataacactcttgagggacatctttcgggagtcaaaggaggcgactccggtgacggatgggcatgcggcgcattaggtagttggtagggtaacggcctaccaagccgacgatgcgtaggggttctgagaggaaggtcccccacattggaactgagacacggtccaaactcctacgggaggcagcagtgaggaatattggtcaatggccggaaggctgaaccagccaagtcgcgtgagggaataaggccctatgggtcgtaaacctcttttatcagggagcaaaggcgtccacgtgtggacgagaggagagtacctgaagaaaaagcatcggctaactccgtgccagcagccgcggtaatacggaggatgcgagcgttatccggatttattgggtttaaagggtgcgtaggcggagtgtcaagtcagcggtaaaatttcggggctcaaccccgtcgtgccgttgaaactgacacccttgagtgagtgagaagtaagcggaatgcgtggtgtagcggtgaaatgcatagatatcacgcagaacgccgattgcgaaggcagcttaccggcgctcaactgacgctgaggcacgaaagtgcgggtatcgaacaggattagataccctggtagtccgcacagtaaacgatgaatgctagatgtccggggcgaatgagctttgggtgtcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgcaggagggatgtttttgaaaggaggcagccagcaatggtctcctgcgaggtgctgcatggttgtcgtcagctcgtgccgtgaggtgtcggcttaagtgccataacgagcgcaacccctacctacagttgccatcgcgtgatggcgggcactctgtggggactgcctgcgcaagcagtgaggaaggcggggatgacgtcaaatcagcacggcccttacgtccggggcgacacacgtgttacaatggcaggtacagcgggaagccacccggcgacggggcgcggaacccgaaaacctgtctcagttcggattggagtctgcaacccgactccatgaagctggattcgctagtaatcgcgcatcagccacggcgcggtgaatacgttcccgggccttgtacacaccgcccgtca

SEQ ID NO: 167 - DNA, 1354 bp, Artificial Sequence
  Synthetic Polynucleotide
gatgaacgctggcggcgtgcctaacacatgcaagtcgaacgaggtaaatgagatgaagttttcggatggattcttatttaccgagtggcggacgggtgagtaacgcgtgggtaacctgcctcatacagggggataacgattggaaacgattgctaataccgcataagcgcacagtaccacatggtacagtgtgaaaaactccggtggtatgagatggacccgcgtctgattagctagttggtgaggtaacggcccaccaaggcaacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccgggtttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttcccttcggggcagtggagacaggtggtgcatggttgtcgtcagctcgtgtcgtgagatgttgggttaagtcccgcaacgagcgcaacccttatccttagtagccagcattttaggtgggcactctagggagactgccagggataacctggaggaaggtggggatgacgtcaaatcatcatgccccttatgacttgggctacacacgtgctacaatggcgtaaacaaagtgaagcaaagctgtgaagccaagcaaatcacaaaaataacgtctcagttcggattgtagtctgcaactcgactacatgaagctggaatcgctagtaatcgcagaatcagaatgctgcggtgaaatacgttcccgggtct

SEQ ID NO: 168 - DNA, 1367 bp, Artificial Sequence
  Synthetic Polynucleotide
agagtttgatcttggctcaggacgaacgctggcggcgtgcttaacacatgcaagtcgaacgaagcatttgcgacagattctttcgggatgaagatgcttatgactgagtggcggacgggtgagtaacgcgtgggtaacctgccttatacagggggatagcagttggaaacgactggtaataccgcataagcgcacggtatcgcatgatacagtgtgaaaaactgaggtggtataagatggacccgcgtctgattagctagttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagagtaggtggcatcgcaagtcagaagtgaaagcccggggctcaaccccgggactgcttttgaaactgcggagctagagtgcaggaggggcaagtggaattcctagtgtagcggtgaaatgcgtagatattaggaggaacaccagtggcgaaggcggcttgctggactgtaactgacactgaggctcgaaagcgtgggaagcaaacaggattagataccctggtagtccacgccgtaaacggatgaattactaggtgtcgggggcacataagtgcttcggggccgcagcaaacgcaaataagtattccaccctggggagtacgttcgcaagaatgaaactcaaaggaattgacggggacccgcacaagcggtggagcatgtggtttaattcgaagcaacgcgaagaaccttaccaagtcttgacatccttctgaccggacagtaatgtgtccttcccttcggggcagaagagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaat

SEQ ID NO: 169 - DNA, 1494 bp, Artificial Sequence
  Synthetic Polynucleotide
gatgaacgctagcgacaggcttaacacatgcaagtcgaggggcagcgggggtaaaggcttgcctttacctgccggcgaccggcgcacgggtgagtaacacgtatgcaacctggccgtcacaggaggataaccgggagaaattccgcctaatactccataacactttccggggacatccccgggaagtcaaagggtttcgacccggtgacggatgggcatgcggcgcattagctagtcggcggggtaacgacccaccgaggcgacgatgcgtaggggttctgagaggaaggtcccccacattggaactgagacacggtccaaactcctacgggaggcagcagtgaggaatattggtcaatgggcggaagcctgaaccagccaagtcgcgtgagggaataaggccctaagggtcgtaaacctcttttgccggggagcaatggtcggcttgcgagcggacagggagagtacccggagaaaaagcatcggctaactccgtgccagcagccgcggtaatacggaggatgcgagcgttatccggatttattgggtttaaagggtgcgtaggcggattgtcaagtcagcggtcaaaagtcggggctcaaccccgtgaagccgttgaaactggcggtcttgagtgagcgagaagcaggcggaatgcgtggtgtagcggtgaaatgcatagatatcacgcagaaccccgattgcgaaggcagcctgccggcgctcaactgacgctgaggcacgaaagtgcggggatcgaacaggattagataccctggtagtccgcacagtaaacgatgaatgctagctgtccggtgcgaatgagcgctgggtggcacagcgaaagcgttaagcattccacctggggagtacgccggcaacggcgaaactcaaaggaattgacgggggcccgcacaagcggaggaacatgtggtttaattcgatgatacgcgaggaaccttacccgggctcaaacgccgcagggatcacttttgaaagggagtgagccagcaatggactgcggcgaggtgctgcatggttgtcgtcagctcgtgccgtgaggtgtcggcttaagtgccataacgagcgcaacccctaccgacagttgctaactggtcaagcagaggactctgtcgggactgccggcgcaagctgcgaggaaggcggggatgacgtcaaatcagcacggcccttacgtccggggcgacacacgtgttacaatggcaggtacagagggaagccacctggcgacagggagcggaacccgaaaacctgtctcagttcggatcggagtctgcaacccgactccgtgaagctggattcgctagtaatcgcgcatcagccacggcgcggtgaatacgttcccgggccttgtacacaccgcccgtcaagccatgggagccgggggtgcctgaaggccgtgaccgcaaggagcggcctagggtaaaaccggtgactggggctaagtcgtaacaaggtagccgtaccggaagg

SEQ ID NO: 170 - DNA, 1332 bp, Artificial Sequence
  Synthetic Polynucleotide
gatgaactctggcggcgcgcctaacacatgcaagtcgaacggcacctgccctcgggcagaagcgagtggcgaacggctgagtaacacgtggagaacctgccccctcccccgggatagccgcccgaaaggacgggtaataccggataccccggggtgccgcatggcaccccggctaaagcgcggaggggaggggatggctccgcggcccatcctgtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacatccggtgtagcggtggaatgcgcagatatcgggtggaacaccggtggcgaaggcggccctctgggccgagaccgacgctggggcgcgaaagctgggggagcgaaaaggattagataccctggtagtcccagccgtaaaggatgacggtagggtgtgggggggcgttccccccgtgccgcagccaacgcattaagcgtcccgcctggggagtacggccgcaaggctaaaactcaaaggaattgacgggggcccgcacaagcagcggagcatgtggtttaatttgaagcaacgcgaagaaccttaccagggcttgacatatgggtgaagcgggggagaccccgtggccgagtgtagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtac

SEQ ID NO: 171 - DNA, 1355 bp, Artificial Sequence
  Synthetic Polynucleotide
gacaaacgctggcggcgtgcctaacacatgcaagtcgagcggggattgcggaagtgcttgcacagaagcaattctagcggcggacgggtgagtaacgcgtgagcaagctgtccttcacagggggataacacttggaaacaggtgctaataccgcataagaccacacagccgcatggcagagaggtcaaaggagaaatccggtgaagggtgcgctcgcgtcccattagatagttggcggggtaacggcccaccaagtcgacgatgggtagccgacctgagagggtgatcggccacactgggactgagacacggcccagactcctacgggaggcagcagtggggaatattgggcaatgggcgaaagccttacccagcaacgccgcgtgagggaagaaggttttcggattgtaaacctctgtcctgggggacgaaggaagtgacggtaccccgggaggaagccccggctaactacgtgccagcagccgcggtaatacgtagggggcgagcgttgtccggaattattgggcgtaaagggcgcgtagacggctgtgtaagttataggtgaaagcccaactttcaaggttggaactgcctgtaatactgcatggcttgagtgcaggagagggaagcggaattcctagtgtagcggtgaaatgcgtagatattaggaggaacaccagtggcgaaggcggctttctggactgtaactgacgttgaggcgcgaaagcgtggggagcaaacaggattagataccctggtagtccacgctgtaaacgatggatgctaggtgtgggaggtatcgaccccttccgtgccggagttaacgcaataagcatcccgcctggggagtacggccgcaaggttgaaactcaaaggaattgacgggggcccgcacaagcagcggagcatgtggtttaattcgaagcaacgcgaagaaccttaccagggcttgacatctgcttaaagcggtggaaacaccgtgtcccttcgggggaagcaagacaggtggtgcatggttgtcgtcagctcgtgtcgtgagatgttgggttaagtcccgcaacgagcgcaacccttatttccagttactaacaggtgaggctgaggactctggagagaccgccggggacaactcggaggaaggtggggacgacgtcaaatcatcatgccccttatgttctgggccacacacgtgctacaatggtgactacaaagagaagcgagaccgtaaggtggagcggatctcaaaaaagtcatcccagttcggattgtgggctgcaacccgcccacatgaagtcggagttgctagtaatcgcggatcagcatgccgcggtgaatacgttcccgggccttgcaca

SEQ ID NO: 172 - DNA, 1345 bp, Artificial Sequence
  Synthetic Polynucleotide
gatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctctgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcgaagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttaggttaagtcccgcaacgagcgcaacccccgccgcgtgttgccatcgggtgatgccgggaacccacgcgggaccgccgccgtcaaggcggaggagggcggggaggacgtcaagtcatcatgccccttatgccctgggctgcacacgtgctacaatggccggtacagagggatgccacctcgcgagggggagcggatcccggaaagccggccccagttcggattggggggtgcaacccgcccccacgaagtcggagttgctagtaatcgcggatcagcatgccgcggtgaataaaaggccgggccttgcactctccgcccgtca

SEQ ID NO: 173 - DNA, 1357 bp, Artificial Sequence
  Synthetic Polynucleotide
ttagagtttgatcctggctcaagatgaacgctggcggcgcgcctaacacatgcaagtcgaacggcacccctcctcggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcgccccatcaggtagacggtggggtgacggccctccgtgccgacagggggtagcggggttgaaaaacagaccggccagattgggactgagacacggcccacactcctaagggaggcagcagtggggaatcttgcgcagtggggggaacctggacccagcaacgctgcgtgcgggacgggaggccttcggggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcgccccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgcaca

SEQ ID NO: 174 - DNA, 1384 bp, Artificial Sequence
  Synthetic Polynucleotide
gacgaacgctggcggcgtgcctaacacatgcaagtcgaacggagaattttatttcggtagaattcttagtggcgaacgggtgagtaacgcgtaggcaacctgccctttagacggggacaacattccgaaaggagtgctaataccggatgtgatcatcgtgccgcatggcaggatgaagaaagatggcctctacaagtaagctatcgctaaaggatgggcctgcgtctgattagctagttggtagtgtaacggactaccaaggcgatgatcagtagccggtctgagaggatgaacggccacattgggactgagacacggcccaaactcctacgggaggcagcagtggggaatcttctgcaatggacgaaagtctgacggagcaacgccgcgtgagtgatgaaggatttcggtctgtaaagctctgttgtttatgacgaacgtgcagtgtgtgaacaatgcattgcaatgacggtagtaaacgaggaagccacggctaactacgtgccagcagccgcggtaatacgtaggtggcgagcgttgtccggaattattgggcgtaaagagcatgtaggcggcttaataagtcgagcgtgaaaatgcggggctcaaccccgtatggcgctggaaactgttaggcttgagtgcaggagaggaaaggggaattcccagtgtagcggtgaaatgcgtagatattgggaggaacaccagtggcgaaggcgcctttctggctgtgtctgacgctgagatgcgaaagccagggtagcgaacaagattcgataccccggtggtcctggccgtaaacgacccctaatgggtgtaggaggaatcgaccccttctgtgccggagttaaggcaataagaaccccgcctggggagtacggccgcaaggttgaaactcaaaggaatagacgggggcccgcccaagcggtggagtatgtggtttaattcgacgcaacgcgaagaaccttaccaaggcttgacattgattgaacgctctagagatagagctttcccttcagggacaagaaaacaggtggtgcatggctgtcgtcagctcgtgtcgtgagatgttgggttaagtcccgcaacgagcgcaacccctatcctatgttaccagcaagtaaagttggggactcatgggagactgccagggacaacctggaggaaggcggggaggacgtcaagtcatcatgccccctatgtcttgggctacacacgtactacaatggtcggaaacagagggaagagaagccgcgaggcagagcaaaccccagaaacccgatctcagttcggatcgcaggctgcaacccgcctgcgtgaagtcggaatcgctagtaatcgcaggtcagcatactgcggtgaataaaatcccgggccttgcaca

SEQ ID NO: 175 - DNA, 1389 bp, Artificial Sequence
  Synthetic Polynucleotide
gacgaactctggcggcgtgcttaacacatgcaagtcgaacggagcttataggaagcttgcttcttgtaaacttagtggcgaacgggtaagtaacgcgtaaccaacctgcccttcagagggggataacaacgggaaaccgttgctaataccgcgtacgaatgaacttcggcatcggagctcattgaaaggtggcctctatttataagctatcgctgaaggagggggttgcgtctgattagctagttggaggggtaacggcccaccaaggcaatgatcagtagccggtctgagaggatgaacggccacattgggactgagacacggcacaaactcctacgggaggcagcagtggggaatcttccgcaatggacgaaagtctgacggagcaacgccgcgtgagtgatgacggccttcgggttgtaaagctctgttaatcgggacgaatggtctttgtgtgaataatgcaaagatttgacggtaccggaatagaaagccacggctagctacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagtttttcttcggaacatcggtgacaggtggtgcatggttgtcgtcagctcgtgtcgtgagatgttgggttaagtcccgcaacgagcgcaacccttatcttcagtagccagcatttaggatgggcactctggagagactgccagggataacctggaggaaggtggggatgacgtcaaatcatcatgccccttatgaccagggctacacacgtgctacaatggcgtaaacaaagggaagcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgcaca

SEQ ID NO: 176 - DNA, 1330 bp, Artificial Sequence
  Synthetic Polynucleotide
agagttcgattctggctcaggatgaacgctggcggcgcgcctaacacatgcaagtcgaacggcacctatcttcggatagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggccccaccgtgccgacaacgggtagccgggttgagagaccgaccggccagattgggactgagacacggcccagactcctacgggaggcagcagtggggaatcttgcgcaatggggggaaccctgacgcagcgacgccgcgtacgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgcaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaaaaggattagataccctggtagtcccagccgtaaaccctttaggggggtgtggggggacgatccccccgtgccgcagccaacgcattaagcgtcccgcctggggagtacggccgcaaggctaaaaatcaaaagaattgacgggggcccgcacaagcagcggagcatgtggtttaatttgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaaccccccccgcgtgttgccatcgggtgatgccgggaacccacgcgggaccgccgccgtcaaggcggaggagggcggggaggacgccaagtcatcatgccccttatgccctgggctgcacacgtgctacaatggccggtacagagggatgccaccccgcgagggggagcggatcccggaaagccggccccagttcggattggggggtgcaacccgcccccacgaagtcggagttgctagtaatcgcggatcagcatgccgcggtg

SEQ ID NO: 177 - DNA, 1363 bp, Artificial Sequence
  Synthetic Polynucleotide
gacgaacgctggcggcgtgcttaatacatgcaagtcgaacgaagatgctgcgaggaagttttcggacggaatcgcagtagactgagtggcggacgggtgagtaacgcgtgagcaacctgcctacaagagggggataacagctggaaacggctgctaataccgcataagaccacgttttcgcatggaagaggggtcaaaggaggaatccgcttgtagatgggctcgcgtcccattagctagttgggagggtaaaggcctaccaaggcgacgatgggtagccgacctgagagggtgatcggccacactggaactgagacacggtccagactcctacgggaggcagcagtagggaatattgggcaatgggggaaaccctgacccagcaacgccgcgtgagggaagaaggttttcggattgtaaacctctgtcctatgggacgaaggaagtgacggtaccataggaggaagctccggctaactacgtgccagcagccgcggtaatacgtagggagcgagcgttgtccggaattactgggcgtaaagggtgcgtaggcggtattttaagtcgcatgtgaaatactcgggcttaacccgggggctgcatgcgaaactggggtactagagtgcaggagaggtaagcggaattcctagtgtagcggtgaaatgcgtagatattaggaggaacaccagtggcgaaggcggcttactggactgtaactgacgctgaggcacgaaagcgtggggagcaaacaggattagataccctggtagtccacgctgtaaaacgatggatactaggtgtaggggtcgaaaaggcttctgtgccggagcaaacgcaataagtatcccgcctggggagtacgaccgcaaggttgaaactcaaaggaattgacgggggcctgcacaagcagcggagcatgtggtttaattcgaagcaacgcgaagaaccttaccaaggcttgacatcctctgacgaacatagagatatgttttcccttcggggcagagagacaggtggtgcatggttgtcgtcagctcgtgtcgtgagatgttgggttaagtcccgcaacgagcgcaacccttgtagctagttgccagcgagtaaagtcgggaactctaggtagactgccggggacaactcggaggaaggtggggacgacgtcaaatcatcatgccccttatgatctgggcgacacacgtgctacaatggcggtcacaaagtgaggcaaacccgcgagggggagcaaaccacaaaaaggccgtcccagttcggactgtagtctgcaacccgactacacgaagctggaatcgctagtaatcgcgaatcagaatgtcgcggtgaatacgctcccgggtcttgcaca

SEQ ID NO: 178 - DNA, 1359 bp, Artificial Sequence
  Synthetic Polynucleotide
gatgaacgctggcggcgtgcttaacacatgcaagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacagtaccacatggtacagtgtgaaaaactccggtggtatgagatggacccgcgtctgattagctagttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgtgtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaataataggtgtcggggcacataagtgctccggtgccgcagcaaacgcaataagtattccacctggggagtacgttcgcaagaatgaaactcaaaggaaaagacgggggcccgcacaagcagtggagtatgtggtttaatttgacgcaacgcgaagaaccttaccaagtcttgacatccctcgacaggcatagaaatatgttttctcttcggagcaaggagacaggtggtgcatggttgtcgtcagctcgtgtcgtgagatgttgggttaagtcccgcaacgagcgcaacccctatctttagtagccagcggtcaggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtaca

SEQ ID NO: 179 - DNA, 1376 bp, Artificial Sequence
  Synthetic Polynucleotide
ttagagtttgatcctggctcaagatgaacgctggcggcgtgcctaacacatgcaagtcgagcgagaatcttttaacggacgcttcggttgaagttaagagtggaaagcggcggacgggtgagtaacgcgtaggcaacctgccccttgcagagggatagcctcgggaaaccgggattaaaaccacataaatcctttttatcgcatgatagagaggacaaagatttatcggcgagggatgggcctgcgtctgattagttagttggtggggtaacggcctaccaaggcgacgatcagtagccgacctgagagggtgaacggccacattggaactgagacacggtccaaactcctacgggaggcagcagtggggaatcttgcacaatgggcgaaagcctgatgcagcaacgccgcgtgagcgaagaaggcctttgggtcgtaaagctctgtcggtagggaagaaggaagtgatggtacctaccgaggaagccccggctaactacgtgccagcagccgcggtaatacgtagggggcgagcgttatccggaattattgggcgtaaagagtacgtaggcggttttttaagcgaggggtataaggcagcggcttaactgctgttggcccctcgaactggaggacttgagtgtcggagaggaaagcggaactcctagtgtagcggtgaaatgcgtagagattaggaggaacaccagtggcgaaggcggctttctggacgacaactgacgctgaggtacgaaagcgtggggagcaaacaggattagataccctggtagtccacgccgtaaacgatgagcactaggtgtcgggttcgcaagaattcggtgccggagttaacgcaataagtgctccgtctggggagtacgcacgcaagtgtgaaactcaagggaattgacggggacccgcacaagcagcggagcatgtggtttaattcgaagcaacgcgaagaaccttaccagggcttgacatccctctgacaggaccttaatcggttttttctacggacagaggagacaggtggtgcatggttgtcgtcagctcgtgtcgtgagatgttgggttaagtcccgcaacgagcgcaacccttgtcattagttgccagcagtaagatggggactctaatgagactgccgtggataacacggaggaaggtggggatgacgtcaaatcatcatgccccttatgtcctgggctacacacgtgctacaatggtcggaacagagagaggcgagaccgtgaggtggagcaaaactcaaaaaccgatcccagttcggattgcaggctgcaacccgcctgcatgaagtcggagttgctagtaatcgcagatcagaatgctgcggtgaatgcgttcccgggtcttgcaca

SEQ ID NO: 180 - DNA, 1369 bp, Artificial Sequence
  Synthetic Polynucleotide
gatgaacgctggcggcgtgcttaacacatgcaagtcgaacgaagcatttagaacggattacttcggtttgaagttctttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaataaaaggtgtcggggcccatcaggggtttcggtgccgcagcaaacgcaataagtattccccctggggaggacgttcgcaagaaagaaattcaaaggaattgacgggggcccgcaccagcggtggggcatgtggtttaatttgaagcaacgcgaagaaccttaccaagtcttgacatcccactgaccggacagtaatgtgtcatttccttcgtgacagtggagacaggtggtgcatggttgtcgtcagctcgtgtcgtgagatgttgggttaagtcccgcaacgagcgcaacccctatccttagtagccagcagtaagatgggcactctagggagagtgccagggataacctggaggaagggggggaggacgtcaaatcatcatgccccctatgacttgggctacacacgtgctacaatggcgtaaacaaagagaagcgaagtggtgaggccaagcaaatcacaaaaataacgtctcagttcggattgtagtctgcaactcgactacatgaagctggaatcgctagtaatcgcagatcagaatgatgcggtgaaaacgttcccgggtcttgcactcaccgccc

SEQ ID NO: 181 - DNA, 1494 bp, Artificial Sequence
  Synthetic Polynucleotide
agtttgatcctggctcaggatgaacgctagcgacaggcttaacacatgcaagtcgaggggcagcggggtgtcagcttgctgacattgccggcgaccggcgcacgggtgagtaacacgtatgcaacctgcccgccacaggggaataaccgggagaaatcccgactaattccgcgtaacaccgccttggggcatcccgaagcggtcaaaggagcgatccggtggcggatgggcatgcggcgcattagctagtcggcggggtaatggcccaccgaggcgacgatgcgtaggggttctgagaggaaggtcccccacactggtactgagacacggaccagactcctacgggaggcagcagtgaggaatattggtcaatgggcgagagcctgaaccagccaagtcgcgtgagggaagacggccctacgggttgtaaacctcttttgtcagggagcaagaaagggcacgcgtgccctactgagagtacctgaagaaaaagcatcggctaactccgtgccagcagccgcggtaatacggaggatgcgagcgttatccggatttattgggtttaaagggtgcgtaggcgggtcgccaagtcagcggtaaaattgcggggctcaaccccgtcgagccgttgaaactggcggtcttgagtgggcgagaagtacgcggaatgcgtggtgtagcggtgaaatgcatagatatcacgcagaactccgattgcgaaggcagcgtaccggcgcccaactgacgctgaagcacgaaagcgtgggtatcgaacaggattagataccctggtagtccacgcagtaaacgatgaatgctagctgtccgggccgagtgaggcctgggtggcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgcactacgaataccggtgaaagccggtagccagcaatggcggagtgcgaggtgctgcatggttgtcgtcagctcgtgccgtgaggtgtcggcttaagtgccataacgagcgcaacccctaccgacagttgctaactggtcaagcagaggactctgtcgggactgccggcgcaagctgcgaggaaggcggggatgacgtcaaatcagcacggcccttacgtccggggcgacacacgtgttacaatggcaggtacagcgggaagccacctggcgacagggagcagaacccgaaaacctgtctcagttcggattggagtctgcaacccgactccatgaagctggattcgctagtaatcgcgcatcagccatggcgcggtgaatacgttcccgggccttgtacacaccgcccgtcaagccatgggagccgggggtacctgaagtgcgctaccgcgaggagcgccctaaggtaaaactggtgactggggctaagtcgtaacaaggtagcc

SEQ ID NO: 182 - DNA, 1385 bp, Artificial Sequence
  Synthetic Polynucleotide
catgcaagtcgaacggcacccacccccgggtggaagcgagtggcgaacggctgagtaacacgtgaccaacctgcccggctctcggggatagccgcgggaaaccgcgggtaatacccggcgaacccgcccggacgcatgtccgggcgggcgaagctttcgcggagccggatggggtcgcggcccatcaggtagacggcggggtgacggcccaccgtgcctacaacgggtagccgggttgagagaccgaccggccagattgggactgagacacggcccagactcctacgggaggcagcagtggggaatcttgcgcaatgggggcaaccctgacgcagcgacgccgcgtgcgggacgaaggccttcgggtcgtaaaccgctttcagcagggacgagtcaagacggtacctgcagaagaagccccggctaactacgtgccagcagccgcggtaatacgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaattcccggtgtagcggtggaatgcgcagatatcgggaggaacaccggtggcgaaggcggccctctgggccgagaccgacgctgaggcgcgaaagctgggggagcgaacaggattagataccctggtagtcccagccgtaaacgatggacgctaggtgtggggggagagtccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgctagtgaagccggggagacccggtggccgagaggagctagcacaggtggtgcatggctgtcgtcagctcgtgtcgtgagatgttgggttaagtcccgcaacgagcgcaacccccgccgcatgttgccagcaggtagagctgggcacccatgcgggaccgccggcgccaagccggaggagggcggggacgacgtcaagtcatcatgccccttatgccctgggctgcacacgtgctacaatggccggtacagcgggatgcgatggcgcgagccggagcggatccctcaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagccgccggcccaacccgttcgcgggagggaggcgtcgaag

SEQ ID NO: 183 - DNA, 1386 bp, Artificial Sequence
  Synthetic Polynucleotide
acacatgcaagtcgaacggcacccacctccgggtggaagcgagtggcgaacggctgagtaacacgtggagaacctgccccctcctccgggatagccgcgggaaaccgcgggtaataccggatgacgcccgggaagcgcatgctgcccgggccaaagcccagacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatgggggaaaccctgacgcagcgacgccgcgtgcgggacgaaggccttcgggtcgtaaaccgctttcagcagggacgagacaagacggtacctgcagaagaagccccggctaactacgtgccagcagccgcggtaatacgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgtttggttaagtccagcaacgagcgcaacccccgccgcatgttgccagcaggtagagctgggcacccatgcgggaccgccggcgccaagccggaggagggcggggacgacgtcaagtcatcatgccccttatgccctgggctgcacacgtgctacaatggccggtacaacgggatgcgatggcgcgagccggagcggatccctcaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagccgccggcccaaccctttcgggagggaggcgtcgaag

SEQ ID NO: 184 - DNA, 1501 bp, Artificial Sequence
  Synthetic Polynucleotide
agtttgatcctggctcagattgaacgctggcggaacgctttacacatgcaagtcgaacggtaacgaggaggaaagcttgctttcctctgtcgacgagtggcgaacgggtgagtaagacatcggaacgtatccgctcgtgggggacaacttcccgaaaggggagctaataccgcatgagatccgaggatgaaagagggggacccgcgagggcctctcgcgagcggagcggccgatgactgattagctagttggtaaggtaaaggcttaccaaggcgacgatcagtagctggtctgagaggacgaccagccacactgggactgagacacggcccagactcctacgggaggcagcagtggggaattttggacaatgggcgcaagcctgatccagctattccgcgtgtgggaagacggccttcgggttgtaaaccacttttgtagagaacgaaaagtctattgataataccgatagatgatgacggtactctaagaataagcaccggctaactacgtgccagcagccgcggtaatacgtagggtgcgagcgttaatcggaattactgggcgtaaagggtgtgcaggcggttttgcaagatggatgtgaaagccccgggcttaacctgggaaagccatacatgactgcaagactagagtgcgtcagaggggggtggaattccaagtgtagcagtgaaatgcgtagatatttggaagaacaccgatggcgaaggcagccccctgggacgcaactgacgctcatacacgaaagcgtggggagcaaacaggattagataccctggtagtccacgccctaaacgatgtcaactagttgttgggaggtaaaactttcagtaacgcagctaacgcgagaagttgaccgcctgggaagtacggtcgcaagactaaaactcaaaggaattgacggggacccgcacaagcggtggatgatgtggattaattcgatgcaacgcgaaaaaccttacctacccttgacatggcagacaactccttgtaatgaggagggctcgcaagaggatctgcacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagcgaagccgagaggcggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcaaacaatgggagtggtgtttaccagaagtcgttagcctaaccgcaaggagggcggcgaccacggtgagcaccgtgactaatgttaagtcgtaacaaggtaccc

SEQ ID NO: 185 - DNA, 1411 bp, Artificial Sequence
  Synthetic Polynucleotide
agagtttgatcctggctcaggacgaacgctggcggcatgcctaacacatgcaagtcgaacggagattatttcggtaatcttagtggcgaacgggtgagtaacgcgtaggcaacctgccctttagttggggacaacatcccgaaaggggtgctaataccgaatgtgacagtttttccgcatgggattactgtgaaagatggcctctatttataagctatcgctaaaggatgggcctgcgtctgattagctagttggtggggtaacggcctaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgatgaagggattcgttccgtaaagctcttttgtttatgacgaatgtgcagactgtgaataatggtttgtaatgacggtagtaaacgaataagccacggctaactacgtgccagcagccgcggtaatacgtaggtggcgagcgttgtccggaattattgggcgtaaagagcatgtaggcggttttttaagtccggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgagtgaccgctctagagatagagctttcccttcggggacacgaaaacaggtggtgcatggctgtcgtcagctcgtgtcgtgagatgttgggttaagtcccgcaacgagcgcaacccctatcctatgttaccaacacgtaatggtggggactcataggagactgccaaggacaacttggaggaaggcggggatgacgtcaagtcatcatgccccttatgtcttgggctacacacgtactacaatggtcgacaacagagggaagcgaagccgcgaggcagagcaaaccccagaaactcgatctcagttcggatcgcaggctgcgacccgcctgcgtgaagtcggaatcgctagtaatcgcaggtcagcatactgcggtgaatatattcccggggcgcttgtacacaccgcccgt

SEQ ID NO: 186 - DNA, 1404 bp, Artificial Sequence
  Synthetic Polynucleotide
  misc_feature (795)..(795): n is a, c, g, or t
gagtttgatcctggctcaggatgaacgctagcgacaggcttaacacatgcaagtcgaggggcagcgggtcagagtgcttgcactttgatgccggcgaccggcgcacgggtgagtaacacgtatgcaacctgcccgggacagacggataaccggaagaaattccgactaatacggcatgagaccccgaggggacatccccttggagttaaaggaagcaattccggtcccggatgggcatgcggcgcattaggcagttggcggggtaacggcccaccaagccgacgatgcgtaggggttctgagaggaaggtcccccacattggaactgagacacggtccaaactcctacgggaggcagcagtgaggaatattggtcaatggccggaaggctgaaccagccaagtcgcgtgagggactaaggccctacgggtcgtaaacctcttttgtcggggagcaatgggtgacttgcgagtcatcagggagagtacccgaagaaaaagcatcggctaactccgtgccagcagccgcggtaatacggaggatgcgagcgttatccggatttattgggtttaaagggtgcgcaggcggtacggaaagtcagcggtaaaattacggagctcaactccgccgagccgttgaaacttccgcactagagtgagcgagaagtaagcggaatgcgtggtgtagcggtgaaatgcatagatatcacgcagaacgccgattgcgaaggcagcttaccggcgctcaactgacgctcaggcacgaaagtgcgggtatcgaacaggattagataccntggtagtccgcacagtaaacgatgaatactagatgtccggaggaattgacctctgggtgtcacagcgaaagcgttaagtattccacctggggagtacgccggcaacggtgaaactcaaaggaattgacggggcccgcacaagcggaggaacatgtggtttaattcgatgatacgcgaggaaccttacccgggctcaaacgtcacaggaatgacatttgaaaggatgtcagtctttggacctgtgacgaggtgctgcatggttgtcgtcagctcgtgccgtgaggtgtcggcttaactgccataacgagcgcaacccccaccgacagttgctaactggtcaagcagaggactccgtcgggactgccggcgcaagctgagaggaaggcggggatgacgtcaaatcagcacggcccttacgtccggggcgacacacgtgttacaatggcaggtacagcgggaagcgaccgagcgatcggcagcagaacccgaaaacctgcctcagttcggatcggagtctgcaacccgactccgtgaagctggattcgctagtaatcgcgcatcagccatggcgcggtgaatacgttcccgggcctgtacacaccgcccgtc

SEQ ID NO: 187 - DNA, 1402 bp, Artificial Sequence
  Synthetic Polynucleotide
  misc_feature (774)..(774): n is a, c, g, or t
agagtttgatcctggctcaggatgaacgctagcggcaggcttaacacatgcaagtcgaggggcagcgggaggagtgcttgcactccttgccggcgaccggcgcacgggtgagtaacacgtatgcaacctaccctaatcagggggacaacccggcgaaagccgggctaatcccgcgtacatctccttagggcatccttaggagaggaaaggcttcggccggattaggatgggcatgcggcgcattaggtagtcgggggtgtaacggaccaccgagccgacgatgcgtaggggttctgagaggaaggtcccccacactggtactgagacacggaccagactcctacgggaggcagcagtgaggaatattggtcaatggtcggaagactgaaccagccaagccgcgtgaaggatgaaggtacttagtatcgtaaacttcttttgtcagggagcaacggacgccacgtgtggcgttatgagtttacctgaagaaaaagcatcggctaactccgtgccagcagccgcggtaatacggaggatgcgagcgttatccggatttattgggtttaaagggtgcgcaggcggcgcggtaagtcagcggtaaaagcccggggctcaaccccggcgagccgttgaaactgccgtgctagagacagatcgaggtatgcggaatgcgcagtgtagcggtgaaatgcttagatattgcgcagaactccgattgcgaaggcagcgtaccggatctgttctgacgctcaggcacgaaagcgtggggatcgnacaggattagataccctggtagtccacgcagtaaacgatgaatactgggtgttcggaatgattgaattctgagtgccgtagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacaggcgaccgtccaagagattggatttcccttcggggcggctgtcgaggtgctgcatggttgtcgtcagctcgtgccgtgaggtgtcggcttaagtgccataacgagcgcaacccctgcgtatagttgctaacgggtaatgccgaggactctatacggactgccagcgcaagctgtgaggaaggcggggatgacgtcaaatcagcacggcccttacgtcctgggcgacacacgtgttacaatggggtggaacagagggaagccatgtggcgacacagagcagaacccgaaaacacctctcagttcggatcggagtctgcaacccgactccgtgaagctggattcgctagtaatcgcgcatcagccatggcgcggtgaatacgttcccggggcctgtacacaccgcccgtc

SEQ ID NO: 188 - DNA, 1408 bp, Artificial Sequence
  Synthetic Polynucleotide
gagtttgatcctggctcatgatgaacgctagcgacaggcttaacacatgcaagtcgaggggcagcggaggtaaaggcttgcctttacctgccggcgaccggcgcacgggtgagtaacacgtatgcaacctggccgtcacaggaggataaccgggagaaattccgcctaatactccataacactttccggggacatccccgggaagtcgaaggaatttattccggtgacggatgggcatgcggcgcattagctagtcggcggggtaacggcccaccgaggcgacgatgcgtaggggttctgagaggaaggtcccccacattggaactgagacacggtccaaactcctacgggaggcagcagtgaggaatattggtcaatgggcggaagcctgaaccagccaagtcgcgtgagggaataaggccctaagggtcgtaaacctcttttgccggggagcaatggttcgcttgcgagcggacagggagagtacccggagaaaaagcatcggctaactccgtgccagcagccgcggtaatacggaggatgcgagcgttatccggatttattgggtttaaagggtgcgtaggcggaccatcaagtcagcggtcaaaagtcggggctcaaccccgtaaagccgttgaaactggtggtcttgagtgagcgagaagcaggcggaatgcgtggtgtagcggtgaaatgcatagatatcacgcagaaccccgattgcgaaggcagcctgccggcgctcaactgacgctgaggcacgaaagtgcggggatcgaacaggattagataccctggtagtccgcacagtaaacgatgaatgctagctgtccgggtcgaatgagacctgggtggcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgccgcaggaatcacatctgaaaggaagtgagccagcaatggtctgcggcgaggtgctgcatggttgtcgtcagctcgtaaagtgaggtgtcggctcaagtgccataacgagcgcaacccctaccgacagttgctaactggtcaagcagaggactctgtcgggactgccggcgcaagctgtgaggaaggcggggatgacgtcaaatcagcacggcccttacgtccggggcgacacacgtgttacaatggcaggtgcagagggaagccacctggcgacagggagcggaacccgaaaacctgtctcagttaggatcggagtgtgcaacccgactccgtgaagctggattcgctagtaatcgcgcatcagccatggcgcggtgaatacgtcccggggcctgtacacaccgcccgtca

SEQ ID NO: 189 - DNA, 1397 bp, Artificial Sequence
  Synthetic Polynucleotide
agagtttgatcctggctcaggacgaacgctggcggcgtgcttaacacatgcaagtcgaacgctgaaggcccagcttgctgggttggatgagtggcgaacgggtgagtaacacgtgagtaacctgcccccttctttgggataacggtcggaaacggctgctaataccgggtattcactgtccttcgcatggggggtggtggaaaggttttttctggtggggaatgggctcgcggcctatcagcttgttggtggggtgatggcttaccaaggctttgacgggtaaccggcctgagagggtgaccggtcacattgggactgagatacggcccagactcctacgggaggcagcagtggggaatattgcacaatgggcgaaagcctgatgcagcgacgcccgcgtgagggatgacggccttcgggttgtaaacctctttcgctcatggtcaagccgcaactgtggttgtggtgagggtagcgggtaaagaagcaccggctaactacgtgccagcagccgcggtaatacgtagggtgcgagcgtcgtccggaattattgggcgtaaagggcttgtaggcggtttgtcgcgtctgccgtgaaatcctctggcttaactgggggcgtgcggtgggtacgggcaggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttttgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgttatggtggggactcgtgggggactgccggggttaactcggaggaaggtggggatgacgtcaaatcatcatgccccttatgtcttgggcttcacgcatgctacaatggctggtacagagggttgcgatactgtgaggtggagcgaatcccttaaagccggtctcagttcggattggggtctgcaactcgaccccatgaaggtggagtcgctagtaatcgcagatcagcaacgctgcggtgaatacgttctcgggccttgcacacaccgcccgtca

SEQ ID NO: 190 - DNA, 1385 bp, Artificial Sequence
  Synthetic Polynucleotide
  misc_feature (730)..(730): n is a, c, g, or t
  misc_feature (787)..(787): n is a, c, g, or t
agtttgatcctggctcagattcaacgctggcggcatgctttacacatgcaagtcgaacggcagcacagggagcttgctcccgggtggcgagtggcgcacgggtgagtaatacatcggaacgtgtcctgttgtgggggataactgctcgaaagggtggctaataccgcatgagacctgagggtgaaagcgggggatcgcaagacctcgcgcaattggagcggccgatgcccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggccttcgggttgtaaactgcttttgtcagggacgaaaaggaccgtgttaataccatggtctgctgacggtacctgaagaataagcaccggctaactacgtgccagcagccgcggtaatacgtagggtgcaagcgttaatcggaattactgggcgtaaagcgtgcgcaggcggttctgtaagacagatgtgaaatccccgggctcaacctgggaattgcatttgtgactgcaggactagagttcatcagaggggggtggaatccaagtgtagcagtgaaatgcgtagatatttggaagaacaccaatggcgaaggcagccccctgngatgcgactgacgctcatgcacgaaagcgtggggagcaaacaggatagataccctgntagtccacgccctagacgatgtctaatggttgttggggtttttcaaccgtggtaatgaagctcacgcatgaagtagaccgcttggggagtacgttcgcaagagtataattcaaaggaattgacggggacccgcacaaacggtggatgatgtggactaagttgatgacacgcgcaaaaccttacctagccttgacatgtcaggaatcgtgaagagattcgggagtgccggcaagggaatttggagacaggtgctgcatggctgtagtcagctcgtgtcgtgagatgatgggttaagtcccgctacgagcgcaaccggtgtcattagcttctaagcaagagcactgtagtgagctgcgcggagccaaaccggaggaaggtggggatgaggtcaagtcctcatggccctgatggagagggcgtgacacgtcatacaatgctcgggtcatgagggcagtgatagccacaaggtggagcaaatatcagaaaaccgatcataccctggaatgcagtattcaactgggctgcatgaagtaggaagtgggtagtaatcgcggatcagcattcgacggtgaataggttcccaggtcttgtacacacc

SEQ ID NO: 191 - DNA, 1482 bp, Artificial Sequence
  Synthetic Polynucleotide
agagtttgatcatggctcaggacgaacgctggcggcgtgcctaacacatgcaagtcgaacggggatacgttttcggatgtattctagtggcgtacgggtgagtaacgcgtgagcgacctgacctaaagagggggataacatcgagaaatcgatgctaataccgcataagaccacggtatcgcatgatacagaggtcaaaggagtaatccgctttgggaggggctcgcgtcccattagatagtaggcggggtaatggcccacctagtcaacgatgggtagccgagctgagaggctgatcggccacactggaactgagacacggtccagactcctacgggaggcagcagtggggaatattgggcaatgggcgaaagcctgacccagcaacgccgcgtgagggaagaaggttttcggattgtaaacctctgttgcagatgacgaagaaagtgacggtaatctgtgaggaagccccggctaactacgtgccagcagccgcggtaatacgtagggggcgagcgttgtccggaattactgggcgtaaagggtgcgtaggcggttaattaagttggatgtgaaatacccgggcttaacctggggggtgcattcaaaactggttaactagagttcaggagagggaagcggaattcctagtgtagcggtgaaatgcgtagatattaggaggaacaccagtggcgaaggcggctttctggactgacactgacgctgaggcacgaaagcgtggggagcaaacaggattagataccctggtagtccacgcggtaaacgatgaatactaggtgtagggggtatcaactccctctgtgccgcagctaacgcaataagtattccgcctggggagtacggccgcaaggttgaaactcaaaggaattgacgggggcccgcacaagcagcggagcatgtggtttaattcgacgcaacgcgaagaaccttaccaaggcttgacatcctgctaaaaccatagagatatggtgtcccttcgggggagcagagacaggtggtgcatggttgtcgtcagctcgtgtcgtgagatgttgggttaagtcccgcaacgagcgcaacccctgttgccagttaccagcacgtaatggtgggaactctggtgagactgccggggacaactcggaggaaggtggggacgacgtcaaatcatcatgccccttatgtcttgggctacacacgtgctacaatggctgtaacaaagggaagcgacagcgagagctgaagcggatctcagaaaagcagtcccagttcggattgtgggctgcaacccgcccacatgaagtcggagttgctagtaatcgcggatcagcatgccgcggtgaatacgttcccgggccttgtacacaccgcccgtcacaccatgggagttgggagcgcccgaagccggtatcctaaccgtaaggagggagccgtctaaggtgagaccaatgactggggtgaagtcgtaacaaggtaaccgta

SEQ ID NO: 192 - DNA, 1476 bp, Artificial Sequence
  Synthetic Polynucleotide
gtttgattctggctcaggacgaacgctggcggcgtgcttaacacatgcaagtcgaacggacgaagccccttcgggggccgagttagtggcggacgggtgagtaacgcgtgagcaacctgcccataagagggggataacatcgggaaaccgatgctaataccgcataagaccacgatagcacatgctaatgaggtcaaaggagcaatccgcttatggaggggctcgcgtcccattaggtagatggtgaggtaacggcccaccatgccgacgatgggtagccggactgagaggttgaacggccacactgggactgagacacggcccagactcctacgggaggcagcagtggggaatattgggcaatgggggaaaccctgacccagcaacgccgcgtgaaggaagaaggttttcggattgtaaacttctgtcctaagggaagaaagaaatgacggtaccttaggaggaagccccggctaactacgtgccagcagccgcggtaatacgtagggggcaagcgttgtccggaattattgggcgtaaagggtgcgtaggcggccgatcaagtcaggtgtgaaagacccgtgcttaacatgggggttgcacttgaaactggttggcttgagtatgggagaggcaagcggaattcccggtgtagcggtgaaatgcgtagagatcgggaggaacaccagtggcgaaggcggcttgctggaccaaaactgacgctgaggcacgaaagcgtgggtagcaaacaggattagataccctggtagtccacgccgtaaacgatggatactaggtgtagggggtttaacaccttctgtgccggagcaaacgcaataagtatcccgcctggggagtacgatcgcaagattgaaactcaaaggaattgacgggggcccgcacaagcagcggagcatgtggtttaattcgaagcaacgcgaagaaccttaccaaggcttgacatcccctgacagacatagaaatatgttatctcttcggagcagggagacaggtggtgcatggttgtcgtcagctcgtgtcgtgagatgttgggttaagtcccgcaacgagcgcaacccctacatttagttaccagcgggtaaagccggggactctagatggactgccggggacaactcggaggaaggtggggacgacgtcaaatcatcatgccccttatgtcttgggctacacacgtgctacaatggccgttacaaagggaagcgagtgcgtaagcaggagcggaacccataaaagcggtcccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccggtggcttaaccgcaaggagagagccgtcgaaggtgagatcaatgactggggtgaagtcgtaacaaggtaacc

SEQ ID NO: 193 - DNA, 1397 bp, Artificial Sequence
  Synthetic Polynucleotide
gacgaacgctggcggcgtgcctaacacatgcaagtcgaacggagaattttatttcggtagaattcttagtggcgaacgggtgagtaacgcgtaggcaacctaccctttagacggggacaacattccgaaaggagtgctaataccggatgtgatcatcgtgccgcatggcaggatgaagaaagatggcctctacaagtaagctatcgctaaaggatgggcctgcgtctgattagctagttggtagtgtaacggactaccaaggcgatgatcagtagccggtctgagaggatgaacggtcacattgggactgagacacggcccaaactcctacgggaggcagcagtggggaatcttccgcaatggacgaaagtctgacggagcaacgccgcgtgagtgatgaaggatttcggtctgtaaagctctgatgtttatgacgaacgtgcagtgtgtgaacaatgcattgcaatgacggtagtaaacgaggaagccacggctaactacgtgccagcagccgcggtaatacgtaggtggcgagcgttgtccggaattattgggcgtaaagagcatgtaggcggcttaataagtcgagcgtgaaaatgcggggctcaaccccgtatggcgctggaaactgttaggcttgagtgcaggagaggaaaggggaatttccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtacccccgcctggggagtacggccgcaaggttgaaactcaaaggaattgacgggggcccgcacaagcggtggagtatgtggtttaattcgacgcaacgcgaagaaccttaccaaggcttgacattgagcgccatacccagagatgggtagttcccttcggggacgtgaaaacaggtggtgcatggctgtcgtcaactcgtgtcgtgagatgttgggttaagtcccgcaacgagcgcaacccctatcctatgttaccagcaagtaaagttggggactcatgggagactgccagggacaacctggaggaaggcggggatgacgtcaagtcatcatgccccttatgtcttgggctacacacgtactacaatggtcggaaacagagggaagcgaagccgcgaggcagagcaaaccccagaaacccgatctcagttcggatcgcaggctgcaacccgcctgcgtgaagtcggaatcgctagtaatcgcaggtcagcatactgcggtgaatacgttcccgggccttgcacacagcgcccgtc

SEQ ID NO: 194 - DNA, 1485 bp, Artificial Sequence
  Synthetic Polynucleotide
attgaacgctggcggcatgccttacacatgcaagtcgaacggcagcgcgggagcttgctcctggcggcgagtggcgaacgggtgagtaatacatcggaacgtgtccgtttgtgggggacaaccagccgaaaggttggctaataccgcataagacctgagggtgaaagccggggaccgcaaggcctggcgcagacggagcggccgatgattgattagcttgttggcggggtaaaggcccaccaaggcgacgatcaatagctggtctgagaggacgaccagccacactggaactgagacacggtccagactcctacgggaggcagcagtggggaattttggacaatgggggcaaccctgatccagccatgccgcgtgcgggaagaaggccttcgggttgtaaaccgcttttgtcagggacgaaaagggacgggttaagagctagttccgctgacggtacctgaagaataagcaccggctaactacgtgccagcagccgcggtaatacgtagggtgcaagcgttaatcggaattactgggcgtaaagcgtgcgcaggcggttgggtaagacagatgtgaaatccccgggcttaacctgggaactgcatttgtgactgtccgactggagtacgtcagaggggggtggaattccgcgtgtagcagtgaaatgcgtagatatgcggaagaacaccgatggcgaaggcagccccctgggacgcaactgacgctcatgcacgaaagcgtggggagcaaacaggattagataccctggtagtccacgccctaaacgatgtctgccggttgttggggatttctatcttcagtaacgaagctaacgcgtgaagcagaccgcctggggagtacggtcgcaagattaaaactcaaaggaattgacggggacccgcacaagcggtggatgatgtggattaattcgatgcaacgcgaaaaaccttacctagccttgacatgtcaggaatgcttcgtaaatgaggcagtgcccgcaagggaacctgagcacaggtgctgcatggctgtcgtcagctcgtgtcgtgagatgttgggttaagtcccgcaacgagcgcaacccttgtcatcagttgctacgaaagggcactctgatgagactgccggtgacaaaccggaggaaggtggggatgacgtcaagtcctcatggcccttatggctagggcctcacacgtcatacaatggtcggaacagagggcagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaaggcgtttgcccaaccgcaaggaaggcggcgcccacggtgggtttcatgactggggtgaagtcgtaacaaggtagtcgtaccggaagg

SEQ ID NO: 195 - DNA, 1460 bp, Artificial Sequence
  Synthetic Polynucleotide
gacgaacgctggcggcgtgcttaacacatgcaagtcgaacgggagaggatgaggaaatgcttcggcatggagacatccgatctagtggcggacgggtgagtaacgcgtgagcaacctgtcctgcacagggggataacactgagaaatcagtgctaataccgcatgagaccacagtatcacatggtacaggggtcaaaggagaaatccggtgcagggtgggctcgcgtcccattagctagttggtagggtaaaggcctaccaaggcgacgatgggtagccggactgagaggttggccggccacactgggactgagacacggcccagactcctacgggaggcagcagtggggaatattgggcaatgggcgaaagcctgacccagcaacgccgcgtgaaggaagaaggtctttggattgtaaacttttgtcctatgggaagaaggaagtgacggtaccatgggaggaagccccggctaactacgtgccagcagccgcggtaatacgtagggggcgagcgttgtccggaattactgggcgtaaagggcgcgcaggcggccgatcaagttagatgtgaaatacccgggcttaacctgggaactgcatttaaaactggttggctaggagtgcaggagagggaagcggaattcctagtgtagcggtgaaatgcgtagatattaggaggaacaccagtggcgaaggcggctttctggactgtaactgacgctgaggcgcgaaagcgtggggagcgaacaggattagataccctggtagtccacgctgtaaacgatgaatactaggtgtagggggtatcgaccccccctgtgccggagcaaacgcaataagtattccgcctggggagtacggccgcaaggttgaaactcaaaggaattgacgggggcccgcacaagcagcggagcatgtggtttaattcgaagcaacgcgaagaaccttaccaggtcttgacatccctcgaagtgcatagagatatgtacgtccttcgggacgaggagacaggtggtgcatggttgtcgtcagctcgtgtcgtgagatgttgggttaagtcccgcaacgagcgcaacccctacagttagttaccagcgggtaaagccggggactctaacaggactgccgtggataacacggaggaaggtggggacgacgtcaaatcatcatgctccttatgacctgggctacacacgtgctacaatggccggtacaaagagaagcgagaccgtaaggtggagcggatctcaaaaaaccggtcccagttcggattgtgggctgcaacccgcccacatgaagttggagttgctagtaatcgcgaatcagcatgtcgcggtgaatgcgttcccgggccttgtacacaccgcccgtcacaccatgggagttgggagcgcccgaagtcgttgaggtaacccgcaagggagccaggcgccgaaggtgagaccgataactggggtg

SEQ ID NO: 196 - DNA, 1467 bp, Artificial Sequence
  Synthetic Polynucleotide
gacgaacgctggcggcgtgcctaacacatgcaagtcgaacggtgaaggggcctgcttttgtgggtcctggatgagtggcgaacgggtgagtaacacgtgagtaacctgcccccttcttctggataaccgcatgaaagtgtggctaatacgggatattctgggtctgtcgcatggtgggcctgggaaaggttttttccggtgggggatgggctcgcggcctatcagcttgttggtggggtgatggcctaccaaggcggtgacgggtagccggcctgagagggtggacggtcacactgggactgagacacggcccagactcctacgggaggcagcagtgggaaatattgcacaatgggcgcaagcctgatgcagcgacgccgcgtgcgggatggaggccttcgggttgtaaaccgcttctataggggggcaagctatgcctgtgtggtgtggtgagtggactttatgaataagcaccggctaactacgtgccagcagccgcggtaatacgtagggtgcaagcgttgtccggatttattgggcgtaaagggctcgtaggcggtttgttgcgtctggtgtgaaagcttactgcttaacggtaggttgcgctggatacgggcaggcttgagtgcagtaggggagactggaattctcggtgtaacggtggaatgtgtagatatcgggaagaacacctatggcgaaggcaggtctctgggctgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatggcctaaccggtttgccggggggagtggtcgaaggtgggattggcgattgggacg

SEQ ID NO: 197 - DNA, 1491 bp, Artificial Sequence
  Synthetic Polynucleotide
cgctggcggcatgcctaacacatgcaagtcgaacggagattacttcggtaatcttagtggcgaacgggtgagtaacgcgtaggcaacctgccctttagatggggacaacattccgaaagggatgctaataccgaatgtgaagcagacatcgcatgatgactgtttgaaagatggcctctacaagtaagctatcgctaaaggatgggcctgcgtctgattagctagttggtacggtaacggcgtaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctctgttgtctatgacgaatgtgctgattgtgaataatgattagtaatgacggtagtagacgaggaagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacggaattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgaatgacgatcttagagataagattttcccttcggggacatgaaaacaggtggtgcatggctgtcgtcagctcgtgtcgtgagatgttgggttaagtcccgcaacgagcgcaacccctatcctatgttaccagcgagtaaagtcggggactcataggagactgccaaggacaacttggaggaaggcggggatgacgtcaagtcatcatgccccttatgccttgggctacacacgtactacaatggtcgacaacagagggaagcgaagccgcgaggcagagcaaaccccagaaactcgatctcagttcggattgcaggctgcagctcgcctgcatgaagtcggaatcgctagtaatcgcaggtcagcatactgcggtgaatacgttcccgggccttgtacacaccgcccgtcacgccacgaaagttggtaacacccgaagccggtggggtaaccgaaaggagccagccgtctaaggtggggccgatgattggggtgaagtcgtaacaaggtagccgtag

SEQ ID NO: 198 - DNA, 1357 bp, Artificial Sequence
  Synthetic Polynucleotide
ctggcggcgtgcttaacacatgcaagtcgaacgaagaactagagaggaattcttcggaaggaatttttagttacttagtggcggacgggtgagtaacgcgtgagcaacctgcccataagagggggataacagctggaaacggctgctaataccgcataagaccacattgccacatggcagaggggtcaaagatttatcgcttatggatgggctcgcgtctgattagctagttggtagggtaacggcctaccaaggcgacgatcagtagccgacctgagagggtgatcggccacactggaactgagacacggtccagactcctacgggaggcagcagtggggaatattgggcaatgggggaaaccctgacccagcaacgccgcgtgagggaagaaggctttcgagttgtaaacctctgtcctatgggaagaagaaagtgactgtaccataggaggaagctccggctaactacgtgccagcagccgcggtaatacgtagggagcaagcgttgtccggaattactgggcgtaaagggtgcgtaggcggcgcagttagtcagaagtgaaatatcggggcttaactccgggactgcttctgatactgctgtgctcgagtgcaggagaggtaagtggaattcctagtgtagcggtgaaatgcgtagatattaggaggaacaccagtggcgaaggcgacttactggactgtaactgacgctgaggcacgaaagcgtgggtagcaaacaggattagataccctggtagtccacgctgtaaacgatgaaattcttaggtgtgggggtcataagacttttgttccgggagcaaacgcaaataagtattcccgcctggggagtacggccgcaaggctgaaactcaaaggaattgacgggggcccgcacaagcagcggagcatgtggtttaattcgaagcaacgcgaagaaccttaccaaggcttgacatcccgatgaccggcgtagagatacgccttctcttcggagcatcggtgacaggtggtgcatggttgtcgtcagctcgtgtcgtgagatgttgggttaagtcccgcaacgagcgcaacccctattgttagttgccagcatttcggatgggaactctaatgagactgccggggataactcggaggaaggtggggacgacgtcaaatcatcatgccctttatgtcttgggctacacacgtgctacaatggtcggtacaaagagcagcgaactcgtaagagtaagcgaatctcaaaaagccggtctcagttcggattgtgggctgcaacccgcccacatgaagtcggagttgctagtaatcgcggatcagcatgccgcggtgaatgcgttcccgggccttgcaca

SEQ ID NO: 199 - DNA, 1474 bp, Artificial Sequence
  Synthetic Polynucleotide
agttcgatcctggctcaggatgaacgctggcggcgtgcctaacacatgcaagtcgagcgagaaactcatgacagaagcttcggttgaagtcatgggtggaaagcggcggacgggtgagtaacgcgtaggcaacctgccctttgcagagggatagcctcgggaaaccgggattaaaacctcatgatgccgtgtgaagacatcttcatatggtcaaagatttatcggcaaaggatgggcctgcgtctgattagctggttggtggggtaacggcttaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggaagaaggcctttgggtcgtaaacttctgttctgagggaagaaagtgacggtacctcaggagcaagtcccggctaactacgtgccagcagccgcggtaatacgtagggggcaagcgttatccggaattattgggcgtaaagagtacgtaggtggttacctaagcacggggtataaggcaatggctcaaccattgtttgccttgtgaactgggctacttgagtgcaggagaggaaagcggaattcctagtgtagcggtgaaatgcgtagatattaggaggaacaccagtggcgaaggcggctttctggactgtaactgacactgaggtacgaaagcgtggggagcaaacaggattagataccctggtagtccacgccgtaaacgatgagcactaggtgtcggggtcgtaagacttcggtgccgcagttaacgcaataagtgctccgcctggggagtacgttcgcaagaatgaaactcaaaggaattgacggggacccgcacaagcagcggagcatgtggtttaattcgaagcaacgcgaagaaccttaccagggcttgacatccctctgacatacctgtaatggggtatttctacggacagaggagacaggtggtgcatggttgtcgtcagctcgtgtcgtgagatgttgggttaagtcccgcaacgagcgcaacccttgtcattagttgccagcagtaagatgggcactctaatgagactgccggggacaactcggaggaaggtggggatgacgtcaaatcatcatgccccttatgttctgggctacacacgtgctacaatggtcggtacagagaggaagcgaactcgtgagggggagcgaatctataaaaccgatcccagttcggattgcaggctgcaactcgcctgcatgaagtcggagttgctagtaatcgcagatcagaatgctgcggtgaatgcgttcccgggtcttgtacacaccgcccgtcacaccatggaagttgggggcgcccgaagttggcagagaaatatgttacctaaggcgaaatcaatgactggggtgaagtcgtaacaaggtaccc

SEQ ID NO: 200 - DNA, 1542 bp, Artificial Sequence
  Synthetic Polynucleotide
agagtttgatcatggctcaggacgaacgctggcggcgtgcttaacacatgcaagtcgaacgagacgattgaaagcttgcttttgaaagtcgagtggcaaacgggtgagtaacgcgtagacaacctgcctctcagatggggacaacatcccgaaaggggtgctagtaccgaatgttgtgcaacttccacatggaggatgcaccaaaggtggtttcggccaccgctgagagatgggtctgcgtctgattagcttgttggcggggtaacggcccaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcggctcgtaaagctctgttgaaggggacgaacggtaggcataggaaatgatgcttatttgacggtacctttcgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatggaaactatctttcttgagtgcaggagaggaaagcggaattcctagtgtagcggtgaaatgcgtagatattaggaggaacaccagtggcgaaggcggctttctggactgtaactgacgctgaggctcgaaagccaggggagcgaacgggattagataccccggtagtcctggccgtaaacgatgaatactaggtgtaggaggtatcgaccccttctgtgccggagttaacgcaataagtattccgcctggggagtacggccgcagggctgaaactcaaaggaattgacgggggcccgcacaagcggtggagtatgtggtttaattcgacgcaacgcgaagaaccttaccagggcttgacattgagtgacaaggttagagataacctcttctcttcggagacacgaaaacaggtggtgcatggctgtcgtcagctcgtgtcgtgagatgttgggttaagtcccgcaacgagcgcaacccttgtcctttgttgccagcacgcaatggtgggaactcaaaggagactgccgtggagaacacggaggaaggtggggatgacgtcaagtcatcatgccccttatgtcctgggctacacacgtactacaatgggacggacagagagcagcgaagccgcgaggtgaagcgaacctcataaaccgtctcccagttcggattgcaggctgcaacccgcctgcatgaagtcggaatcgctagtaatcgcaggtcagcatactgcggtgaatacgttcccgggccttgtacacaccgcccgtcacaccacggaagtcattcacacccgaagccggtggcctaacttaggagggagccgtctaaggtgggggcgatgactggggtgaagtcgtaacaaggtagccgtatcggaaggtgcggctggatcacctcctt

SEQ ID NO: 201 - DNA, 1510 bp, Artificial Sequence
  Synthetic Polynucleotide
agagtttgatcatggctcaggacgaacgctggcggcgtgcttaatacatgcaagtcgaacggaggcagagacttcggtttctgtcttagtggcgaacgggtgagtaacgcgtgaataacctgactcaaagagggggataacaatcggaaacgattgctaataccgcataagaccacaacaccgcatgatgaaggggtcaaagagatatcgctttgagaggggttcgcgtcccattaggtagttggaggggtaacggcccaccaagccaacgatgggtagccgagctgagaggctgatcggccacactggaactgagacacggtccagactcctacgggaggcagcagtagggaatattgggcaatgggcgcaagcctgacccagcaacgccgcgtgagggaagaaggttttcggattgtaaacctctgtcctatgtgacgaaggaagtgacggtagcataggaggaagccccggctaactacgtgccagcagccgcggtaatacgtagggggcgagcgttgtccggaattactgggcgtaaagggtgcgtaggcggtttggtaagttggatgtgaaatacccgggcttaacttgggggctgcatccaatactgctgaacttgagtgcaggagaggaaagcggaattcctagtgtagcggtgaaatgcgtagatattaggaggaacaccggtggcgaaggcggctttctggactgtaactgacgctgaggcacgaaagcgtggggagcaaacaggattagataccctggtagtccacgctgtaaacgatgaatactaggtgtagggggtatagactccctctgtgccgcagctaacgcaataagtattccgcctggggagtacggccgcaaggttgaaactcaaaggaattgacgggggcccgcacaagcagcggagcatgtggtttaattcgacgcaacgcgaaaaaccttaccaagacttgacatcctactaaactcatggaaacatgaggtgacttcggtcgagtagagacaggtggtgcatggttgtcgtcagctcgtgtcgtgagatgttgggttaagtcccgcaacgagcgcaacccctgttgccagttaccagcgagtaaagtcggggactctggtgagactgccgtggagaacacggaggaaggtggggacgacgtcaaatcatcatgccccttacgtcttgggctacacacgtgctacaatggctgtaacaaagggaagcgacatcgtaagatgaagcagatctcataaaggcagtcccagttcggattgtgggctgcaacccgcccacatgaagtcggagttgctagtaatcgcggatcagcatgccgcggtgaatacgttcccgggccttgtacacaccgcccgtcacaccatgggagttgagagcgcccgaagccaatagtctaaccgcaaggaggacgttgtctaaggtgagatcaatgactggggtgaagtcgtaacaaggtagccgtatcggaaggtgcggctggatcacctcctt

SEQ ID NO: 202 - DNA, 1405 bp, Artificial Sequence
  Synthetic Polynucleotide
tcgccttagagttgatctggctcagattgaacgctggcggcaggcttaatacatgcaagtcgaacggtaacagcaaaaaagcttgcttttttggctgacgagtggcggacgggtgagtaatacctaggaagctgcctaaacgagggggataacacctggaaacgggtgctaataccgcatgataccgcaaggtcaaaggttggtttaccaatcgcgtttagatgcgcctaggagggattagctagttggtggggtaacggctcaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaagggattcgtcccgtaaagctctgttgtatatgacgaatgtgcagattgtgaataatgatttgtaatgacggtagtatacgaggaagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtgggaggtatcgaccccttccgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgattgaaagacctagagataggtccctctcttcggagacaagaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcggcaacagagggaagcaaagccgcgaggcagagcaaaccccagaaacccgatctcagttcggattgcaggctgcaactcgcctgcatgaagtcggaatcgctagtaatcgcaggtcagcatactgcggtgattactatcccgggcgttgtactcaccgcccgtca

SEQ ID NO: 203 - DNA, 1343 bp, Artificial Sequence
  Synthetic Polynucleotide
  misc_feature (914)..(916): n is a, c, g, or t
ggacgaacgctggcggcgtgcctaacacatgcaagtcgaacggggatactttgatttcggttgaagtattctagtggcgaacgggtgagtaacgcgtgaacaacctgacctaaagagggggataacgtcgagaaatcggtgctaataccgcataagaccacgatgccgcatggcaatggggtcaaagatttattgctttaggaggggttcgcgtcccattaggtagatggcggggtaaaggcccaccatgccgacgatgggtagccgagctgagaggctgatcggccacactggaactgagacacggtccagactcctacgggaggcagcagtggggaatattgggcaatgggcgcaagcctgacccagcaacgccgcgtgagggaagaaggctttcgggttgtaaacctctgtcgcaagggacgaagaagtgacgctaccttgtgaggaagccccggctaactacgtgccagcagccgcggtaatacgtagggggcgagcgttgtccggaattactgggcgtaaagggagcgtaggcggtcttttaagttggatgtgaaatacccgggcttaacttggggggtgcattcaaaactgggggactagagtacaggagagggaagcggaattcctagtgtagcggtgaaatgcgtagatattaggaggaacaccagtggcgaaggcggctttctggactgacactgacgctgaggctcgaaagcgtggggagcaaacaggattagataccctggtagtccacgctgtaaacgatgaatactaggtgtagggggtatcaactccctctgtgccgcagcaaacgcaataagtattccgcctggggagtacggccgcaaggttgaaactcaaaggaattgacgggggcccgcacaagcagcggagcatgtggtttaatnnnacgcaacgcgaagaaccttaccaaggcttgacatcctactaaacccatagagatatggggtggcttcggccgagtagagacaggtggtgcatggttgtcgtcagctcgtgtcgtgagatgttgggttaagtcccgcaacgagcgcaacccctgttgccagttaccagcaagtaaagttggggactctggtgagactgccggggacaactcggaggaaggtggggacgacgtcaaatcatcatgccccttatgtcttgggctacacacgtgctacaatggctgtaacaaagggaagcgaccttgtaagaggaagcggatctcagaaaagcagtcccagttcggattgtgggctgcaacccgcccacatgaagtcggagttgctagtaatcgcggatcagcatgccgcggtgaatacgttcccgggcct

SEQ ID NO: 204 - DNA, 1511 bp, Artificial Sequence
  Synthetic Polynucleotide
acgaacgctggcggcatgcctaacacatgcaagtcgaacggaggaaactcaacattaagaattttaatgcgccaagcggtaaaaattatgagcgaagcgaataatttttactacgcaaataagcagactaacaattcactgcttgagttaatcggaacattggagtttttaatgttgagtttccttagtggcgaacgggtgagtaacgcgtaggcaacctgccctctagatggggacaacattccgaaaggggtgctaataccgaatgtgatccttcttccgcatgaaggaaggatgaaagatggcctctacatgtaagctatcgctagaggatgggcctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgatgaagggattcgtcccgtaaagctctgttgtctgtgacgaatgtgcagattgtgaataatgatctgtaatgacggtagcagacgaggaagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgcgatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgaatgaccgctctagagatagagctttcccttcggggacatgaaaacaggtggtgcatggctgtcgtcagctcgtgtcgtgagatgttgggttaagtcccgcaacgagcgcaacccctatcctatgttaccagcgagtaatgtcggggactcataggagactgccaaggacaacttggaggaaggcggggatgacgtcaagtcatcatgccccttatgtcttgggctacacacgtactacaatggtcggcaacagagggaagcgaagccgcgaggcagagcaaaccccagaaacccgatctcagttcggatcgcaggctgcaacccgcctgcgtgaagtcggaatcgctagtaatcgcaggtcagcatactgcggtgaatacgttcccgggccttgtacacaccgcc

SEQ ID NO: 205 - DNA, 1506 bp, Artificial Sequence
  Synthetic Polynucleotide
acgaacgctggcggcatgcctaacacatgcaagtcgaacggagattgctcaacatcaagtttttcaaacttgacgacagcgataaaatttatgagcgaagcgaataaattttatcacgcaaataagcatgactaataatcatcaaatgtgagattgaaggatttgatgttgagcaatcttagtggcgaacgggtgagtaacgcgtaggcaacctgccctttagatggggacaacattccgaaaggggtgctaataccgaatgtgattactctctcgcatgagagagtaatgaaagatggcctctacatgtaagctatcgctaaaggatgggcctgcgtctgattagctagttggtggggtaacggctcaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctctgttgttaaggacgaatgtgcaggttgcgaacagttacctgtaatgacggtacttaacgaggaagccacggctaactacgtgccagcagccgcggtaatacgtatgtggcgagcgttgtccggaattattgggcgtaaagagcatgtaggcggttttttaagtcccggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagatacccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgagtgaccgctctagagatagagcttctccttagggagcacgaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcggcaacagagggaagcgaagccgcgaggcagagcaaaccccagaaacccgatctcagttcggattgcaggctgcaactcgcctgcatgaagtcggaatcgctagtaatcgcaggtcagcatactgcggtgaatacgttcccgggccttgtacacaccgc

SEQ ID NO: 206 - DNA, 1517 bp, Artificial Sequence
  Synthetic Polynucleotide
tataaattaagagtttgatcctggctcaggatgaacgctggcggcgtgcttaacacatgcaagtcgagcgagaaactacatgcagacacttcggtagaagcgagtagcggaaagcggcggacgggtgagtaacgcgtaggcaacctgcccttcacagaggtatagcctcgggaaaccgggattaaaaccacataaaatcataggttcgcatgaaccaaaggtcaaagatttatcggtgaaggatgggcctgcgtctgattagctggttggtagggtaaaagcctaccaaggcgacgatcagtagccgacctgagagggtgatcggccacattggaactgagacacggtccaaactcctacgggaggcagcagtgggggatattgcacaatgggggaaaccctgatgcagcaacgccgcgtgaggtatgaaggcctttgggttgtaagcctctgtcctaggggaagaaaaaaatgacggtacccgaggaggaagccccggctaactacgtgccagcagccgcggtaatacgtagggggcaagcgttatccggaattattgggcgtaaagagtgcgtaggtggtctactaagcgcgaggtgaaaggcaatggctcaaccattgttagccttgcgaactggcagacttgagtgcaagagaggaaagcggaattcctagtgtagcggtgaaatgcgcagatattaggaggaacaccggcggcgaaggcggctttctggattgtaactgacactgaggcacgaaagcgtgggtagcaaacaggattagataccctggtagtccacgccgtaaacgatgagcactaggtgtcgggacatgagtctcggtgccgcagttaacgcaataagtgctccgcctggggagtacgcacgcaagtgtaaaactcaaaggaattgacggggacccgcacaagcagcggagcatgtggtttaattcgaagcaacgcgaagaaccttaccaagacttgacatccctctgacgtacccttaatcgggtatttcttcggacagaggagacaggtggtgcatggttgtcgtcagctcgtgtcgtgagatgttgggttaagtcccgcaacgagcgcaacccttgtctttagttgccatcattaagttgggcactctaaagagactgccggggaaactcggaggaaggtggggatgacgtcaaatcatcatgccccttatgtcttgggctacacacgtgctacaatggccggtacaaagagaagcgataccgcaagggggagcaaatcttaaaaaccggtcccagttcggattgcaggctgcaactcgcctgcatgaagtcggagttgctagtaatcgcagatcagaatgctgcggtgaatgcgttcccgggtcttgtacacaccgcccgtcacaccatggaagttgggggcgcccgaagttggtcgacaatagattacctaaggcgaaatcaatgactggggtgaagtcgtaacaaggtagccgtatcggaaggtgcggctggatcacctcctttct

SEQ ID NO: 207 - DNA, 1455 bp, Artificial Sequence
  Synthetic Polynucleotide
ggcggcatgctttacacatgcaagtcgaacggcagcacagggagcttgctcctgggtggcgagtggcgcacgggtgagtaatacatcggaacgtgtcctattgtgggggataactgtcggaaagggtggctaataccgcataagacctgagggtgaaagcgggggatcgcaagacctcgcgcaattggagcggccgatgcccgattagctagttggtgaggtaatagcttaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaaggattgtgctaataccatgatctgctgacggtacctgaagaataagcaccggctaactacgtgccagcagccgcggtaatacgtagggtgcaagcgttaatcggaattactgggcgtaaagcgtgcgcaggcggttctgtaagacagatgtgaaatccccgggctcaacctgggaattgcatttgtgactgcaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacaggattagataccctggtagtccacgccctaaacgatgtctactggttgttggggattaatatccttggtaacgaagctaacgcgtgaagtagaccccctggggagagcggtcgcaagattaaaactcaaaggaattgacggggacccgcacaagcggtggatgatgtggattaattcgatgcaacgcgaaaaaccttacgtagccttgacatgccaggaatcctgaagagatttgggagtgcccgcaagggaatctggacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgtctaaccgtaaggaaggacggcgtccacggtgggtttcatgactggggtgaagtcgt

SEQ ID NO: 208 - DNA, 1507 bp, Artificial Sequence
  Synthetic Polynucleotide
  misc_feature (742)..(742): n is a, c, g, or t
agagtttgatcatggctcaggacgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatggaagagatattaaagatggcctctacttgtaagctatcgctttgcgatgggtctgcgtctgattagctagttggtggggcaacggcctaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaaggtcttcggatcgtaaagctctgttgtcggggacgaatgttgaggcctagaatataggtttcaaatgacggtacctgacgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatagaaactatcattcttgagtgcaggagaggaaagcggaattcctagtgtagcggtgaaatgcgtagatattaggaggaacaccagtggcgaangcggctttctggactgtaactgacgctgaggctcgaaagccaggggagcgaacgggattagataccccggtagtcctggccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaaaggctggagacagcctcctcccttcggggacacgaaaacaggtggtgcatggctgtcgtcagctcgtgtcgtgagatgttgggttaagtcccgcaacgagcgcaacccctatctcttgttgccagcacgcggaggtgggaactcaagagagactgccgcggacaacgtggaggaaggcggggatgacgtcaagtcatcatgccccttatgtcctgggctacacacgtactacaatgggatggacagagagcagcgaagccgtgaggcagagcgaaccccataaaccatctcccagttcggattgcaggctgcaacccgcctgcatgaagtcggaatcgctagtaatcgcaggtcagcatactgcggtgaatacgttcccgggccttgtacacaccgcccgtcacaccacggaagtcattcacacccgaagccggtggggtaaccgctaagagggccagccgtctaaggtgggggcgatgactggggtg

SEQ ID NO: 209 - DNA, 1436 bp, Artificial Sequence
  Synthetic Polynucleotide
agagtttgatcatggctcagagcgaacgctggcggcaggcttaacacatgcaagtcgaacgggcgcttcggtgctagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaacggctcaccaaggcaacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggctttcgggtcgtaaacttctgtccttggggaagaaaaaaatgacggtacccatggaggaagccccggctaactacgtgccagcagccgcggtaatacgtagggggcgagcgttatccggaattattgggcgtaaagagtgcgtaggtggttacctaagcgcagggtttaaggcaacggctcaaccattgttcgccttgcgaactgggctacttgagtgcaggagaggaaagcggaattcctagtgtagcggtgaaatgcgtagatattaggaggaacaccagtggcgaaggcggcttttctggactgtaactgacactgaggcacgaaagcgtggggagcaaacaggattagataccctggtagtccacgccgtaaacgatgagcactaggtgtcggggtcgcaagacttcggtgccgcagttaacgcattaagtgctccgcctggggagtacgcacgcaagtgtgaaactcaaaggaattgacggggacccgcacaagcagcggagcatgtggtttaattcgaagcaacgcgaagaaccttaccagaacttgacatccttctgacaacaccttaatcggtgtcttccttcgggacagaagagacaggtggtgcatggttgtcgtcagctcgtgtcgtgagatgttgggttaagtcccgcaacgagcgcaacccttgtcattagttgccatcattaagttgggcactctagtgagactgccggggacaactcggaggaaggtggggatgacgtcaaatcatcatgccccttatgttctgggctacacacgtgctacaatggccggtacagaaagcagcgaaaccgcgaggtggagccaatctcaaaaaccggtcccagttcggactgcaggctgaaactcgcctgcacgaagttggagttgctagtaatcgcagatcagaatgctgcggtgaatgcgttcccgggtcttgtacacaccgcccgtcacaccacggaagttgggggtgcccgaagttggtcgagaaatagattacctaaggcaaaatcaatgactggggtgaagtcgtaacaaggtaacc

SEQ ID NO: 210 - DNA, 1388 bp, Artificial Sequence
  Synthetic Polynucleotide
cctggctcatgatgaacgctagcgacaggcctaacacatgcaagtcgaggggcagcgggtgaggtagcaatacctttgccggcgaccgtgcgcacgggctgagtaacacgtatgcaatccacctgtaacagggggataacccggagaaatccggactaataccccataatatgggctctccgcatggagggtccattaaagagagcaattttggttacagacgagcatgcgctccattagccagttggcggggtagcggcccaccaaagcgacgatggataggggttctgagaggaaggtcccccacattggaactgagacacggtccaaactcctacgggaggcagcagtgaggaatattgatcaatgttcggcagactgaaccagccaagtcgcgtgagggaagacggccctacggcttgtaaacctcttttgtcggagagtaaagtacgctacgtgtagcgtattgcaagtatccgaagaaaaagcatcggctaactccgtgccagcagccgcggtaatacggaggatgcaagcgttatccggatttattgggtttaaagggtgcgtaggcggtacgccaagtcagcggtgaaattttcgggctcaacccggactgtgccgttgaaactggcgagctagagtgcacaagaggcaggcggaatgcgtggtgtagcggtgaaatgcatagatatcacgcagaacctcgattgcgaaggcagcctgctagggtgcgacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatatatatgaaagtatatagctagcaatagtcacctgcgaggtgctgcatggttgtcgtcagctcgtgccgtgaggtgtcggcttaagtgccataacgagcgcaacccctatcgacagttactaacgggtcaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgtacacaccgcc

SEQ ID NO: 211 - DNA, 1379 bp, Artificial Sequence
  Synthetic Polynucleotide
cctggctcacattgaacgctggcggcatgctttacacatgcaagtcgaacggcagcgaggggagcttgctccctggcggcgagtgacgcacggatgagtaatacatcggaacgtgacttctagtggggcagaactgcccgaaaggacagctaataccgccggagacctgagggtgaaagcgggggatcgcaagacctcgcgctgtaagagcggccgatgtccgattagctagttggtgaggtaaaggctcaccaaggcgacgatcggtagctggtctgagaggacgaccagccacactgggactgagacacggcccagactcctacggcaggcagcagtgggaaattttggacaatgggggcaaccctgatccagccatgccgcgtgcaggatgaaggtcttcggattgtaaactgcttttgtcagggacgaaaagggatgcgataacaccgcattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaaaaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagcccgcctggggagtacgctcgcaagattaaaactcaaaggaattgacggggacccgcacaagcggtggatgatgtggattaattcgatgcaacgcgaaaaaccttacctagccttgacatgccaggaaggtctgagagatcagaccgtgcccgcaagggaatctggacacaggtgctgcatggcagtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcc

SEQ ID NO: 212 - DNA, 1378 bp, Artificial Sequence
  Synthetic Polynucleotide
cctggctcaggatgaacgctggcggcgtgcttaacacatgcaagtcgaacgaagcatttgcgacagatttcttcgggatgaagttgcttatgactgagtggcggacgggtgagtaacgcgtgggtaacctgccttgtactgggggataacagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaagaggaacaccagtggcgaaggcggctcactggactgtaactgacactgaggcttgaaagcgtggggagcaaacaggattaaataccttggttgtccacgccgtaaacgatgaatattaggtgtcggggcccatatgggcttcggtgccgcagcaaacgcaataagtattccacctggggagtacgttcccaagaatgaaactcaaaggaattgacggggacccgcacaagcggtggagcatgtggtgtaattcgaagcaacgcgaagaaccttaccaagtcttgacatcccactgaccggacagtaatgtgtcctttccttcgggacagtggtgacaggtggtgcatggtcgtcgtcagctcgcgtcgtgagatgttgggttaagttccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggtcaagcaaatcacaaaaataacgtctcagttcggattgtagtctgcaactcgactacatgaagctggaatcgctagtaatcgcagatcagaatgctgcggtgaatacgttcccgggtcttgttacaccgcccg

SEQ ID NO: 213 - DNA, 1380 bp, Artificial Sequence
  Synthetic Polynucleotide
cctggctcaggatgaacgctagcgacaggcttaacacatgcaagtcgaggggcagcgagggagtggcaacacttctgtcggcgaccggcgcacgggtgagtaacgcgtatgcaacctgcccttcacagggggataaccgggagaaattccgactaataccgcatacgtcctccgggggcatccccggaggatgaaagaattatcggtgaaggatgggcatgcgtgatattaggtagttggcggggcaacggcccaccaagcctacgatatctaggggttctgagaggaaggtcccccacattggtactgagacacggaccaaactcctacgggaggcagcagtgaggaatattggtcaatggacgagagtctgaaccagccaagtcgcgtgaaggaagacggatctatggtttgtaaacttctttagtgcgggaacaaagcggtgtcgtgacgccggatgagtgtaccgcaagaataagcatcggctaaccccgtgccagcagccgcggtaatacggaggatgcgagcgttatccggatttattgggtttaaagggagcgcaggctgcgaggcaagtcagcggtcaaatgtcggggctcaaccccggcctgccgttgaaactgtcctgctagagttcgagtgaggtatgcggaatgcgttgtgtagcggtgaaatgcatagatatgacgcagaactccgattgcgaaggcagcataccaactcgcgactgacgctgaggctcgaaagcgtgggtatcgaacaggattagataccctggtagtccacgcagtaaacgatgaatactaactgttcggagggcgacctctgagtggtaaagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgtcgggcgaatcatcctgaaaggggtgagccagcaatggcggccgacgaggtgctgcatggttgtcgtcagctcgtgccgtgaggtgtcggcttaagtgccataacgagcgcaacccccgcgtccagttgccagcgagtagagtcgggcactctggacggactgccggcgcaagccgcgaggaaggcggggatgacgtcaaatcagcacggcccttacgtccggggcgacacacgtgttacaatggcgtggaacagagggaagccacctggcgacagggagcggaacccgaaaacacgtctcagttcggattggagtctgcaactcgactacacgaagctggaatcgctagtaatcgcagatcagaatgctgcggtgaatacgttcccgggtcttgtacacaccgcc

SEQ ID NO: 214 - DNA, 1378 bp, Artificial Sequence
  Synthetic Polynucleotide
cctggctcaggatgaacgctagcgacaggcctaacacatgcaagtcgaggggcatcaggtatcagcttgctgatacgctggcgaccggcgcacgggtgagtaacgcgtatggaatctgtctgtaacagggggataacccggagaaattcggactaataccccatgccgccggttttttgcatgaaaggccggcgaaagggtaaccggttacaggtgatcatgcgttccattagctggttggcggggtaacggcccaccaaggcgacgatggataggggttctgagaggaaggtcccccacactggtactgagacacggaccagactcctacgggaggcagcagtgaggaatattggtcaatgggcggaagcctgaaccagccaagtcgcgtgaaggaagactgccctacgggttgtaaacttcttttgtatgggagtaaaagagtccacgtgtggctattgcaagtaccatacgaataagcatcggctaactccgtgccagcagccgcggtaatacggaggatgcgagcgttatccggatttattgggtttaaagggtgcgtaggcggccctataagtcagcggtgaaatgttccggctcaaccgggaaactgccgttgaaactgtaggactagagtccacaagaggtatgcggaatgcgtggtgtagcggtgaaatgcatagatatcacgcagaaccccgattgcgaaggcagcatactggggtgaaacagacgctgaagcacgaaagcgtgggtatcgaacaggattagataccctggtagtccacgccgtaaacgatgaatactaactgtttgcgatatacagtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcaggaggaatgcgtatgaaagtacgcagctagcaatagccgcctgcgaggtgctgcatggttgtcgtcagctcgtgccgtgaggtgtcggcttaagtgccataacgagcgcaacccttatcgatagttactaccaggtgaagctgaggactcaatcgagactgccagcgtaagctgcgaggaaggtggggatgacgtcaaatcagcacggcccttacgtccggggcgacacacgtgttacaatggcagggacagcgagtagccaggcagcaatgccgcgccaatctcgaaaccctgtcccagttcggatcggagtctgcaactcgactccgtgaagctggattcgctaggaatcgcgcatcagccatggcgcggtgaatacgttcccgagcgttgtacacaccg

SEQ ID NO: 215 - DNA, 1374 bp, Artificial Sequence
  Synthetic Polynucleotide
cctggctcacgatgaacgctggcggcgtgcctaacacatgcaagtcgagcggataacagggaagtgcttgcacggaactgtttttagcggcggacgggtgagtaacgcgtgaacaagctgtccttcacagggggataacacttggaaacaggtgctaataccgcataagaccacaggggtgcatgctccaggggtcaaaggagcaatccggtgaagggtgcgttcgcgtcccattagatagttggcggggcaacggcccaccaagtcgacgatgggtagccgacctgagagggtgatcggccacactgggactgagacacggcccagactcctacgggaggcagcagtggggaatattgggcaatgggcgaaagccttacccagcaacgccgcgtgagggaagaaggttttcggattgtaaacctctgtcctgggggacgaaggaagtgacggtaccccgggaggaagccccggctaactacgtgccagcagccgcggtaatacgtagggggcgagcgttgtccggaattattgggcgtaaagggcgcgtagacggctgagtaagttactggtgaaagcccagcttttaaggctggaattgccggtaatactgttcagcttgagtgcaggagagggaagcggaattcctagtgtagcggtgaaatgcgtagatattaggagaaccaccattggcgaaggcggctttctggactgtaactgacgttgaggcccgaaagcgtgggaagcaaacaggattagataccttggtagtccacgccgtaaacgatggatgctaggtgtgggaggtatcgaccccttccgtgccgcagttaacgcaataagcatcccgcctggggagtacggccgcaaggttgaaactcaaaggaattgacgggggcccgcacaagcagcggagcatgtggtttaattcgacgcaacgcgaagaaccttaccaggacttgacatctgattaagcttgtggaaacacaaggtcccttcgggggaatcaagacaggtggtgcatggttgtcgtcagctcgtgtcgtgagatgttgggttaagtcccgcaacgagcgcaacccttatttccagttactaacaggcagtgctgaggactctggagagaccgccggggacaactcggaggaaggtggggacgacgtcaaatcatcatgccccttatgttctgggctacacacgtgctacaatggtgactacaaagagaagcgaaatcgtaaggtagagcggatctcaaaaaagtcatctcagttcggattgtgggctgcaacccgcccacatgaagtcggagttgctagtaatcgcggatcagcatgccgcggtgaatacgttcccgggccttgtacacaccgcccg

SEQ ID NO: 216 - DNA, 1381 bp, Artificial Sequence
  Synthetic Polynucleotide
cctggctcagattgaacgctggcggcatgctttacacatgcaagtcgaacggcagcacagggagcttgctcccgggtgacgagtggcgcacgggtgagtaatacatcggaacgtgtcctgttgtgggggataactgctcgaaagggtggctaataccgcatgagacctgagggtgaaagcgggggatcgcaagacctcgcgcaattggagcggccgatgcccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggccttcgggttgtaaactgcttttgtcagggacgaaaaggaccgtgttaataccatggtctgctgacggtacctgaagaataagcaccggctaactacgtgccagcagccgcggtaatacgtagggtgcaagcgttaatcggaattactgggcgtaaagcgtgcgcaggcggttctgtaagacagatgtgaaatccccgggcttaacctgggaattgcatttgtgactacaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacaggattagataccctggtagtccacgccctaaacgatgtctactggttgttggggttttttaaccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaatcctgaagagattcgggagtgcccgcaagggaatctggacacaggtgctgcatggctgtcgtcagctcgtgtcgtgagatgttgggttaagtcccgcaacgagcgcaacccttgtcactagttgctacgcaagagcactctagtgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgcaaggaatcgcggatcagcatgccgcggtgaatacgtccctaaatggtgtacacaccgcccg

SEQ ID NO: 217 - DNA, 1367 bp, Artificial Sequence
  Synthetic Polynucleotide
gacgaacgctggcggcgtgcttaacacatgcaagtcgaacgaaaataccaagcttgcttggttgattagtggcgaacgggtgagtaacacgtgagtaacctgccccttactttctggataactgctcgaaagggtagctaatacgggatattctgactagcctgcatgggttggtttggaaaggtttattttctggtaagggatgggctcgcggcctatcagcttgttggtggggtgatggcctaccaaggctttgacgggtagccggcctgagagggtggacggtcacactgggactgagatacggcccagactcctacgggaggcagcagtggggaatattgcacaatgggcgcaagcctgatgcagcgacgccgcgtgagggatgaaggccttcgggttgtaaacctctttcgtcagggaacaaggcactgcttttttggtggtgttgagggtacctggataagaagcgccggctaactacgtgccagcagccgcggtaatacgtagggcgcaagcgttgtccggaattattgggcgtaaagagctcgtaggcggctggtcgcgtctgtcgtgaaaacttccggctcatttttggggcttgcggtgggtacgggccggctagagtgcggtatgggtaactggaactcctggtgtagcggtggaatgcgcagatatcaggaagaacaccgatggcgaaggcaggttactgggccgttactgacgctgaggagcgaaagcgtggggagcgaacaggattagataccctggtagtccacgccgtaaacgttgggcactaggtgtgaggctcctttccgggggttttgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttaaccgtggctctagagatagggtttacccttttgggtggttttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggttgcgatactgtgaggtggagctaatcccttaaagctggtctcagttcggattggtgtctgcaactcgacaccatgaaggtggagtcgctagtaatcgcagatcagcaacgctgcggtgaatacgttctcgggcct

SEQ ID NO: 218 - DNA, 1358 bp, Artificial Sequence
  Synthetic Polynucleotide
gacgaacgctggcggcgtgcttaacacatgcaagtcaaacgctgaaccccatcttgctgggtggatgagtggcgaacgggatgagtaacacgtgagtaacctgcccccttctttgggataacgcccggaaacgggtgctaatactggatattcactggccttcgcatgggggttggtggaaaggttttttctggtgggggatgggctcgcggcctatcagcttggtggtggggtgatggcctaccaaagctttgacgggtatccggcctgagagggtgaccggtcacattgggactgacatacggcccacactcctacgggagagcacagtgggaaatattgcacaatgggcgaaagcctgatgcaacgactccgcgagagggatgacggccttcaggttgtaaacctctttcgctcatgggcaaacctcagctttggattgtggtgagggtagtgggtaaagaagcgccggctaactacatgccagcagccgcggtaatacgtagggcgcgagcgttgtccgaaattattgggcgtaaagggcttgtgggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcggggctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacggcgacactgcagagatgtggtggcatttagttggtcgtgtgcaggtggtgcatggttgtcgtcagctcgtgtcgtgagatgttgggttaagtcccgcaacgagcgcaacccttgccctatgttgccagcacgttatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggcct

SEQ ID NO: 219 - DNA, 1465 bp, Artificial Sequence
  Synthetic Polynucleotide
ggacgaacgctggcggcatgcctaacacatgcaagtcgaacggagattatttcggtaatcttagtggcgaacgggtgagtaacgcgtaggcaacctgccctttagttggggacaacatcccgaaaggggtgctaataccgaatgtgatcacatttccgcatggaattgtgatgaaagatggcctctatttataagctatcgctaaaggatgggcctgcgtctgattagctagttggtggggtaacggctcaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcagactgtgaataatggtttgtaatgacggtagtaaacgaataagccacggctaactacgtgccagcagccgcggtaatacgtaggtggcgagcgttgtccggaattattgggcgtaaagagcatgtaggcggttttttaagtccggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgagtgaccgccatagagatatggctttcccttcggggacacgaaaacaggtggtgcatggctgtcgtcagctcgtgtcgtgagatgttgggttaagtcccgcaacgagcgcaacccctatcctatgttaccagcgggtaatgccggggactcataggagactgccaaggacaacttggaggaaggcggggatgacgtcaagtcatcatgccccttatgtcttgggctacacacgtactacaatggtcgacaacagagggaagcgaagccgcgaggcagagcaaaccccagaaactcgatctcagttcggatcgcaggctgcaacccacctgcgtgaagtcggaatcgctagtaatcgcaggtcagcatactgcggtgaatacgttcccgggccttgtacacaccgcccgtcacaccacgaaagttggtaacacccgaagccggtggggtaacctttaaggagccagccgtctaaggtggggccga

SEQ ID NO: 220 - DNA, 1358 bp, Artificial Sequence
  Synthetic Polynucleotide
gacgaacgctggcggcgtgcttaacacatgcaagtcgaacgatgatgctccagcttgctggggtggattagtggcgaacgggtgagtaacacgtgagtaacctgccctcttctttgggataacagtcggaaacggctgctaatactggatattcactcgttggcgcatgttggtgggtggaaaggttttttctggtgggggatgggctcgcggcctatcagcttgttggtggggtgatggcctaccaaggctttgacgggtaaccggcctgagagggtgaccggtcacattgggactgagatgcggcccagactcctacgggaggcagcagtggggatttttgcacaatgggcgcaagcctgatgcagtgacgccgcgtgagggatgaaggccttcgggttgtaaacctttttcgctcatggtcaagctgcaactgtggttgtggtgagggtagtgggtaaagaagcgccggctaactacgtgccagcagccgcggtaatacgtagggcgcgagcgttgtccggaattattgggcgtaaagggcttgtaggcggttggccgcgtctgccgtgaaatcctctagcttaactgggggcgtgcggtgggtacgggttgacttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggtcgcaaggctaaaactcaaaggaattgacgggggcccgcacaagcggcggagcatgcggattaattcgatgcaacgcgaagaaccttaccaaggcttgacatgcacccagacactgcagagatgtggtggcatttggttgggggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggttggtacagagtgttgcgatactgtgaggtggagcgaatcacttaaagccagtctcagttcggattggggtctgcaactcgaccccatgaaggtggagtcgctagtaatcgcagatcagcaacgctgcggtgaatacgttctcgggcct

SEQ ID NO: 221 - DNA, 1460 bp, Artificial Sequence
  Synthetic Polynucleotide
ctcaggatgaacgctggcggcgtgcttaacacatgcaagtcgaacgaagcatttacgacagatcttttcggagtgaagttgtttatgactgagtggcggacgggtgagtaacgcgtgggtaacctgcctcatacagggggatagcagctggaaacggctggtaataccgcataagcgcacagaatcgcatgattcagtgtgaaaaactccggtggtatgagatggacccgcgtctgattagctagttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcgggggtcaaaagaccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactggcgtaccagtaatgtggtatttccttcgggacagtggtgacaggtggtgcatggttgtcgtcagctcgtgtcgtgagatgttgggttaagtcccgcaacgagcgcaacccttatccttagtagccagcaggtgaagctgggcactctagggagactgccagggataacctggaggaaggtggggatgacgtcaaatcatcatgccccttatgacttgggctacacacgtgctacaatggcgtaaacaaagtgaagcgaaaccgtgaggtcaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtctgtgacctaacgtaagaaggagcagccgaaggcaggtctgataactggggtg

SEQ ID NO: 222 - DNA, 1360 bp, Artificial Sequence
  Synthetic Polynucleotide
gacgaacgctggcggcgtgctcaacacatgcaagtcgaacgctgaagcctagcttttgttgggtggatgagtggcgaacgggtgagtaacacgtgagtaacctgccctcttctttgggataacgcccggaaacgggtgctaatactggatattcactggtcttcgcatgggggttggtggaaagggttttttctggtgggggatgggctcgcggcctatcagcttgttggtggggtgatggcctaccaaggctttgacgggtagccggcctgagagggtgaccggtcacattgggactgagatacggcccagactcctacgggaggcagcagtggggaatattgcacaatgggcgaaagcctgatgcagcgacgccgcgtgagggatggaggccttcgggttgtaaacctctttcgctcatggtcaagccgcaactgtgggttgtggtgagggtagtgggtaaagaagcgccggctaactacgtgccagcagccgcggtaataccttaggcgcgaccgttgtccggaattattgggcgtaaagggcttgtaggcggttggtcgcgtctgccgtgaaatcctctggcttaactgggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggttcctgcgccatagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgaacggcggcactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgaaatcgtgaggtggagcgaatcccttaaagccagtctcagttcggattggggtctgcaactcgaccccatgaaggtggagtcgctagtaatcgcagatcagcaacgctgcggtgaatacgttctcgggcct

SEQ ID NO: 223 - DNA, 1506 bp, Artificial Sequence
  Synthetic Polynucleotide
agagtttgatcctggctcagattgaacgctggcggaacgctttacacatgcaagtcgaacggtaacagcgaggaaagcttgcttttttcggctgacgagtggcgaacgggtgagtaatacatcggaacgtgtccgctcgtgggggacaaccatccgaaaggatggctaataccgcatgagttctacggaagaaagagggggacctgcttgcaggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgacggccctcgggttgtaaaccactttagtagagaacgaaaaggagctatcgaataaatagctctgctgacggtactctaagaataagcaccggctaactacgtgccagcagccgcggtaatacgtagggtgcgagcgttaatcggaattactgggcgtaaagggtgtgcaggcggctgagtaagacagatgtgaaatccccgggcttaacctgggaaccgcatatgtgactgcttggctagagtgcgtcagagggaggtggaattccacgtgtagcagtgaaatgcgtagatatgtggaagaacaccgatggcgaaagcagcctcctgggacgcaactgacgctcatacacgaaagcgtggggagcaaacaggattagataccctggtagtccacgccctaaacgatgtcaactagttgttggggattaaattcctcagtaacgcagccaacgcgtgaagttgaccgcctgggaagtacggtcgcaagactaaaactcaaaggaattgacggggacccgcacaagcggtggatgatgtggattaattcgatgcaacgcgaaaaaccttacctacccttgacatgtcagagaagcttttgtaatgagagtgtgcccgcaagggcgtctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagccaacccgtgagggggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcaaacaatgggagtggtgtttaccagaagtcgttagcctaaccgcaaggagggcggcgaccacggtgagcaccgtgactaatgttaagtcgtaacaaggtaacc

SEQ ID NO: 224 - DNA, 1495 bp, Artificial Sequence
  Synthetic Polynucleotide
agagtttgatcctggctcaggatgaacgctagcggcaggcttaacacatgcaagtcgaggggcagcggggcggaagcttgctttcgccgccggcgaccggcgcacgggtgagtaacacgtatgcaacctgcccccgtcagggggacaacccggcgaaagccgggctaatcccccgtacatccccggagggcatcctccggggaggaaaggcttcggccggacggggatgggcatgcggcgcattagctagttggcggggtaacggcccaccaaggcgacgatgcgtaggggttctgagaggaaggtcccccacactggtactgagacacggaccagactcctacgggaggcagcagtgaggaatattggtcaatggtcgggagactgaaccagccaagccgcgtgagggatgaaggtgctaagcattgtaaacctcttttgtcagggaacaaaggcatccacgagtggatgtgtgagtgtacctgaagaaaaagcatcggctaactccgtgccagcagccgcggtaatacggaggatgcgagcgttatccggatttattgggtttaaagggtgcgtaggcggcctgttaagtcagcggtaaaagcccggggctcaaccccggcgagccgttgaaactggctggctggagttggcgagaggtatgcggaatgcgcggtgtagcggtgaaatgcttagatatcgcgcagaactccgattgcgaaggcagcatgccggcgccagactgacgctgaggcacgaaagcgcggggatcaaacaggattagataccctggtagtccacgcagtaaacgatgaatgctggctgtccggcccggtacagggctgggtggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacggtagacggatgtcgcagagacgcggcagtcccacgggacgtctgccgaggtgctgcatggttgtcgtcagctcgtgccgtgaggtgtcggcttaagtgccataacgagcgcaacccccgcgggcagttgccatcaggtgatgctggggactctgcccggactgccggcgcaagccgcgaggaaggcggggatgacgtcaaatcagcacggcccttacgtccggggcgacacacgtgttacaatggggggtacagcgggaagccaggcggtgacgccgcgcggaacccgaaagcccctctcagttcggatcggagtctgcaacccgactccgtgaagctggattcgctagtaatcgcgcatcagccatggcgcggtgaatacgttcccgggccttgtacacaccgcccgtcaagccatgggagccgggagcgcttgaagtgcgtcgccgcgaggcgcgccctagagcgagaccggtgactggggctaagtcgtaacaaggtaacc

SEQ ID NO: 225 - DNA, 1477 bp, Artificial Sequence
  Synthetic Polynucleotide
agagtttgatcctggctcaggatgaacgctggcggcgtgcctaacacatgcaagtcgagcgagaagctctcgacggatacttcggttgagggagagagtggaaagcggcggacgggtgagtaacgcgtaggcaacctgccttatgcacagggatagccattggaaacgatgattaaaacctgataacactgcattttcacatggaaaagcagtcaaagatttatcggcataagatgggcctgcgtctgattagctagttggtggggtaacggctcaccaaggcaacgatcagtagccgacctgagagggtgatcggccacattggaactgagacacggtccaaactcctacgggaggcagcagtggggaatattgcacaatgggcgaaagcctgatgcagcaacgccgcgtgaaggaagaaggccttcgggtcgtaaacttctgtccttggggaagaagaactgacggtacccaaggaggaagccccggctaactacgtgccagcagccgcggtaatacgtagggggcaagcgttatccggaattattgggcgtaaagagtgcgtaggtggctttttaagcgcagggtttaaggcaatggcccaaccattgttcgccctgcgaactgaatagcttgagtgcaggagaggaaagcggaattcctagtgtagcggtgaaatgcgtagatattaggaggaacaccagtggcgaaggcggctttctggactgtaactgacactgaggcacgaaagtgtggggagcaaacaggattagataccctggtagtccacaccgtaaacgatgagcactaggtgtcggggtcgcaagacttcggtgccggagttaacgcattaagtgctccgcctggggagtacgtacgcaagtatgaaactcaaaggaattgacggggacccgcacaagcagcggagcatgtggtttaattcgaagcaacgcgaagaaccttaccaggacttgacatcctcctgacgtatccgtaatgggatattccttcggacaggagagacaggtggtgcatggttgtcgtcagctcgtgtcgtgagatgttgggttaagtcccgcaacgagcgcaacccttgccattagttgccatcattaagttgggcactctagtgggactgccggggacaactcggaggaaggtggggatgacgtcaaatcatcatgccccttatgttctgggctacacacgtgctacaatggccggtacagaaagcagcgaagtcgcgaggcggagcaaatctcaaaaaccggtcccagttcggactgcaggctgcaacccgcctgcacgaagccggagttgctagtaatcgcgaatcagaatgtcgcggtgaatgcgttcccgggtcttgtacacaccgcccgtcacaccatggaagttgggggtgcccaaagccggcaagcaaatatgctgtctaaggcaaaaccaatgactggggtgaagtcgtaacaaggtaacc

SEQ ID NO: 226 - DNA, 1457 bp, Artificial Sequence
  Synthetic Polynucleotide
gaacgctagcgacaggcctaacacatgcaagtcgaggggcagcgaagaggtagcaatacctttgtcggcgaccggcgcacgggtgagtaacacgtatgcaatccacctgtaacagggggataacccggagaaatccggactaataccccataatatgggcgctccgcatggagagcccattaaagagagcaattttggttacagacgagcatgcgctccattagccagttggcggggtaacggcccaccaaagcgacgatggataggggttctgagaggaaggtcccccacattggaactgagacacggtccaaactcctacgggaggcagcagtgagggaatatgggtcaatggccggcagactgaccagcccaagtcccggggaggaaggacggcccacggggtggtaacccttttttgtcggagagtaaagtacgctacgtgtagtgtattgcaagtatccgaagaaaaaagcatcggctaaactccgtgcccagcagcggcggtaatacggaggatgcaagcgttatcccggatttattgggtttaaagggtgcgtaagcggcacgcccagtcagcggtgaaatttccgggctcaacccggagtgtgccgtgaaactggcgagctagagtacacaagaggcaggcggaatgcgtggtgtagcggtgaaatgcatagatatcacgcagaaccccgattgcgaaggcagcctgctagggtgaaacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatatatatgaaagtatatagctagcaatagtcacctgcgaggtgctgcatggttgtcgtcagctcgtgccgtgaggtgtcggcttaagtgccataacgagcgcaacccctatcgacagttactaacgggtcaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgtacacaccgcccgtcaagccatggaagccgggagtacctgaagcatgcaaccgcaaggagcgtacgaaggtaataccggtaactggggcta

SEQ ID NO: 227 - DNA, 1448 bp, Artificial Sequence
  Synthetic Polynucleotide
gctttacacatgcaagtcgaacggtaacgtggggcggagcttgctccgccccgacgacgagtggcgaacgggtgagtaatacatcggaacgtgtccgctcgtgggggacaaccagccgaaaggttggctaataccgcatgagttctacggaagaaagagggggacccgcaagggcctctcgcgggcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggggaaaccctgatccagctattccgcgtgtgggatgaaggccctcgggttgtaaaccacttttgtagagaacgaaaagacaccatcgaataaatggtgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccctaaacgatgttaactagttgttgggatgtaacaatctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccttgacatgtcaggaagctcttgtaatgagagcgtgcccgcaagggagcctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggtacagagggttgccaagccgcgaggtggagccaatcccagaaaaccgatcgtagtccggatcgcagtctgcaactcgactgcgtgaagtcggaatcgctagtaatcgcggatcagaatgccgcggtgaatacgttcccgggtcttgtacacaccgcccgtcacaccatgggagtgggttctaccagaagtggctagtctaaccgcaaggaggacggtcaccacggtaggattcatgactggggtgaa

SEQ ID NO: 228 - DNA, 1438 bp, Artificial Sequence
  Synthetic Polynucleotide
gcttgcggcgtgcttaacacatgcaagtcgaacgaagcatttgcgacagatttcttcgggatgaagttgcttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctagagtgcaggaggggtgagtggaattcctagtgtagcggtgaaatgcgtagatattaggaggaacaccagtggcgaaggcggctcactggactgtaactgacactgaggctcgaaagcgtggggagcaagcaggattagataccctggtagtccacgccgtaaacgatgaatactaggtgtcggggcccaaaagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtcctttccttcgggacagtggagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgat

SEQ ID NO: 229 - DNA, 1416 bp, Artificial Sequence
  Synthetic Polynucleotide
cctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcaaccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaagcgcgaaagctgggggagcgaacaggatttagataccctggtagtcccagccgtaaacgatggacgctaggtgtggggggacgatccccccgtgccgcagccaacgcattaagcgtcccgcctggggagtacggccgcaaggctaaaactcaaaggaattggcgggggcccactcaagcagcggagcatgtggcttaattcgaagcaacgcgaagaaccttaccagggcttgacatatgggtgaagcgggggagactctgtggccgagaggagcccatacaggtggtgcatggctgtcgtcagctcgtgtcgtgagatgttgggttaagtcccgcaacgagcgcaaccctcgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggctttgtacactccgcccgtctctcctcccgagtcgtctgctcccgaagtcgccggccctaccgtcaaggggggaggctctgaaggtgtggagggtgaggggggtgaagtc

SEQ ID NO: 230 - DNA, 1452 bp, Artificial Sequence
  Synthetic Polynucleotide
gattgaacgctggcggcatgctttacacatgcaagtcgaacggcagcatagagagcttgctctctgatggcgagtggcgaacgggtgagtaatacatcggaacgtgtcctgttgtgggggataactactcgaaagagtggctaataccgcataagacctgcgggtgaaagtgggggaccttcgggcctcgcgcagttggagcggccgatgactgattagctagttggtggggtaaaggcctaccaaggcgacgatcagtagctggtctgagaggacgaccagccacattgggactgagacacggcccaaactcctacgggaggcagcagtggggaattttggacaatgggggcaaccctgatccagccatgccgcgtgcaggatgaaggtcttcggattgtaaactgcttttgtcagggacgaaaagggatgcgataacaccgcattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaaggcctgagagatcaggccgtgcccgcaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgcccaaccgaaaggaaggcggcgtccacggtgggcttcatgac

SEQ ID NO: 231 - DNA, 1441 bp, Artificial Sequence
  Synthetic Polynucleotide
gcctaacacatgcaagtcgaggggcaacatggtatcagcttgctgatactgatggcgaccggcgcacgggtgagtaacgcgtatgtaatctacctgtaacagagggataacccggagaaatccggactaatacctcatagcacatattattcgcatgaattttatgttaaagaaactcggttacagatgaacatgcgttccattatctagttggcggggttacggcccaccccggcaacaatgggtaggggttctgagaggaaggtcccccccactgtgactgagacacggaccacactcctacgggaggcggcagtgaggaatattgtgcactgggcggaagcctgagccacccacgtcgcgtgtaggagaacagccctacgggttgtgaactccttttacctgggaataacgggcgctacgtgtagcgctgtgcaagtaccgggagaataagcatcggctaattccgtgccagcagccgcggtaatacggaagatgcgagcgttatccggatttattgggtttaaagggtgcgtaggcggaagaataagtcagcggtgaaatgcttcagctcaactggagaattgccgatgaaactgtttttctagagtataaaagaggtatgcggaatgcgtggtgtagcggtgaaatgcatagatatcacgcagaaccccgattgcgaaggcagcatactgggctataactgacgctgaagcacgaaagcgtgggtatcgaacaggattagataccctggtagtccacgccgtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacaggggaataatcccgaaaaggattagccagcaatggtcgctgtcgaggtgctgcatggttgtcgtcagctcgtgccgtgaggtgtcggcttaagtgccataacgagcgcaacccttaccggtagttactaacaggtcaagctgaggactctaccgggactgccagcgcaagctgcgaggaaggtggggatgacgtcaaatcagcacggcccttacgtccggggcgacacacgtgttacaatggcaggtacagagagtcgcgtcgtagcaatacgtagccaatcccgaaaacctgtctcagttcggatcggagtctgcaactcgactccgtgaagctggattcgctagtaatcgcgcatcagccatggcgcggtgaatacgttcccgggccttgtacacaccgcccgtcaagccatgggagccgggagtacctgaagtatgcaaccgcaaggagcgtcctagggtaatactggtgactggggctaagtcgta

SEQ ID NO: 232 - DNA, 1449 bp, Artificial Sequence
  Synthetic Polynucleotide
tcagattgaacgctggcggcatgctttacacatgcaagtcgaacgggagcgcggggagcttgctccctggcggcgagtggcgcacgggtgagtaatacatcggaacgtgtcttctagtgggggataactgcccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgcattccgctgacggtacctgaagaataagcaccggctaactacgtgccagcagccgcggtaatacgtagggtgcaagcgttaatcggaattactgggcgtacagcgtgcgcaggcggttctgtaacatagatgtgaaatccccgggctcaccctgggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttgggccgcatggcttagtaacacagctaacgcgagaagttgaccgcctggggagtacggtcgcaagattaaaactcaaaggaattgacggggacccgcacaagcggtggatgatgtggattaattcgatgcaacgcgaaaaaccttacctagccttgacatgccaggaatcctgatgaaagtcgggagtgcccgcaagggaatctggacacaggtgctgcatggctgtcgtcagctcgtgtcgtgagatgttgggttaagtcccgcaacgagcgcaacccttgtcactagttgctacgcaagagcactctagtgaaactgccggtgacaaaccggaggaaggtggggatgacgtcaagtcctcatggcccttatggctagggcctcacacgtcatacaatggtcggaacagagggcagcgaagccgtgaggcggagccaatcccagaaaaccgatcgtagtccggattgcactctgcaactcgagtgcatgaagtcggaatcgctagtaatcgcggatcagcatgccgcggtgaatacgttcccgggtcttgtacacaccgcccgtcacaccatgggagtggggttcaccagaaggcgtttgcctaaccttcgggagggcggcgaccacggtgggtttcat

SEQ ID NO: 233 - DNA, 1443 bp, Artificial Sequence
  Synthetic Polynucleotide
gcatgctttacacatgcaagtcgaacggcagcgcggggagcttgctccctggcggcgagtggcgcacgggtgagtaatacatcggaacgtgtcttctagtgggggataactgcccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgcattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctgcggagtacggtcgcaagattaaaactcaaaggaattgacggggacccgcacaagcggtggatgatgtggattaattcgatgcaacgagaaacactttatatagcctcgacatgtcaggaaggtgtgagatatcagcctgcgtccgcaagggaatctgcacacaggtcatgcatgggtgtcgtcaggtcgtgtgatgagatgttgggttaagtcccgcaacgagcccaacccttgtcattagatcatatgaaagggcactctaatgagactgccggtgacaaaccggaggaaggtggggatgacgtcaagtcatcatggcccttatggttagggcttcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagatgacgtttgtccaaccgaaaggaagacgtcgtccacggtgggcttcatgactggggtg

SEQ ID NO: 234 - DNA, 1501 bp, Artificial Sequence
  Synthetic Polynucleotide
agagtttgatcctggctcaggatgaacgctagcgacaggcttaacacatgcaagtcgaggggcagcgggggaggaagcttgctttctcctgccggcgaccggcgcacgggtgagtaacacgtatgcaacctggccgtcacaggtggataaccggaagaaattccgactaatacagcataacactcctgagggacatccttcgggggtcaaaggaggcgactccggtgacggatgggcatgcggcgcattaggtagttggtagggtaacggcctaccaagccgacgatgcgtaggggttctgagaggaaggtcccccacattggaactgagacacggtccaaactcctacgggaggcagcagtgaggaatattggtcaatggccggaaggctgaaccagccaagtcgcgtgagggaataaggccctatgggtcgtaaacctcttttgtcagggagcaaaggcgtccacgagtggacgaaaggagagtacctgaagaaaaagcatcggctaactccgtgccagcagccgcggtaatacggaggatgcgagcgttatccggatttattgggtttaaagggtgcgtaggcggagtgtcaagtcagcggtaaaatttcggggctcaaccccgtcgtgccgttgaaactgacacccttgagtgagtgagaagtaagcggaatgcgtggtgtagcggtgaaatgcatagatatcacgcagaacgccgattgcgaaggcagcttaccggcgctcaactgacgctgaggcacgaaagtgcgggtatcgaacaggattagataccctggtagtccgcacagtaaacgatgaatgctagatgtccggggcgaatgagtcctgggtgtcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgcctcaggaatcatttgtgaaagcagatgagtcttcggacctgaggcgaggtgctgcatggttgtcgtcagctcgtgccgtgaggtgtcggcttaagtgccataacgagcgcaacccccaccgacagttgctaactggttaagcagaggactctgtcgggactgccggcgcaagctgtgaggaaggcggggatgacgtcaaatcagcacggcccttacgtccggggcgacacacgtgttacaatggcaggtacagcgggaagcgaccgagcgatcggcagcggaacccgaaaacctgtctcagttcggatcggagtctgcaacccgactccgtgaagctggattcgctagtaatcgcgcatcagccatggcgcggtgaatacgttcccgggccttgtacacaccgcccgtcaagccatgggagccgggagtgcctgaaggccgtgaccgcaaggagcggcctaaggtaaaactggtgactggggctaagtcgtaacaaggtaacc

SEQ ID NO: 235 - DNA, 1497 bp, Artificial Sequence
  Synthetic Polynucleotide
agagtttgatcctggctcaggatgaacgctagcgacaggcttaacacatgcaagtcgaggggcagcggggataaagcttgctttatctgccggcgaccggcgcacgggtgagtaacacgtatgcaacctgccctttgcagggggataaccggaagaaattccgactaataccgcataatactttccggagacatctccggggattcaaaggaagcaattccggcaaaggatgggcatgcgtcgcattagctagtcggcggggtaacggcccaccgaggcgacgatgcgtaggggttctgagaggaaggtcccccacactggtactgagacacggaccagactcctacgggaggcagcagtgaggaatattggtcaatgggcgcaagcctgaaccagccaagtcgcgtgagggaagacggtcctatggattgtaaacctcttttgccggggagcaatgcaggtcttgcgaggcctgagggagagtacccggagaaaaagcatcggctaactccgtgccagcagccgcggtaatacggaggatgcgagcgttatccggatttattgggtttaaagggtgcgtaggcgggctgttaagtcagcggtcaaatgtcggggctcaaccccggcctgccgttgaaactggcggtcttgagtgagcgagaagtatgcggaatgcgtggtgtagcggtgaaatgcatagatatcgcgcagaactccgattgcgaaggcagcataccggcgctcaactgacgctgaggcacgaaagcgtggggatcgaacaggattagataccctggtagtccacgcagtaaacgatgaatgctacctgtccggagcttcggttctgggtgggacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgcagacggacgaatcgagaaatcggtttttccttcgggactgtctgcgaggtgctgcatggttgtcgtcagctcgtgccgtgaggtgtcggcttaagtgccataacgagcgcaacccctatctacagttgctaacaggtgaagctgaggactctgtggagactgccggcgcaagctgtgaggaaggcggggatgacgtcaaatcagcacggcccttacgtccggggcgacacacgtgttacaatggcaggtacagcgggaagccacttggcgacaaggagcggaacccgaaaacctgtctcagttcggattggagtctgcaacccgactccatgaagctggattcgctagtaatcgcgcatcagccacggcgcggtgaatacgttcccgggccttgtacacaccgcccgtcaagccatggaagccgggagtgcctgaagtgcgtgaccgcaaggaacgccctagggtaaaaccggtgactggggctaagtcgtaacaaggtaacc

SEQ ID NO: 236 - DNA, 1423 bp, Artificial Sequence
  Synthetic Polynucleotide
tggcggcgtgcgtaacccatgcaagtcgaacgatcagatttccttcggggaagaagcgagtggcggacgggtgagtaacgcgtgaacaaccaaccctatacagggggacaacagctggaaacggctgctaataccgcataagaccacaaggccgcatggccaaggggtcaaaggagcaatccggtataggacgggttcgcgtcccattagctagtaggcggggtaaaggcccacctaggcgacgatgggtagccgagctgagaggctgaccggccacactgggactgagatacggcccagactcctacgggaggcagcaggggggaatattgggcaatgggggaaaccctgacccagcaacgccgcgtgaaggaagaaggccttcgggttgtaaacttctgtgacaggggacgaaggaagtgacggtaccctgagaggaagctccggcaaactacgtgccagcagccgcggtaatacgtagggagcgagcgttgtccggaattactaggcgtaaagggcgcgtaggcggtagatcaagtcgcatgtgaaatacccgggctcaacctggggggtgcatgcgaaactggaatacttgagtgcggtagaggaaagtggaattcctagtgtagcggtgaaatgcgtagatattaggaggaacaccagtggcgaaggcgactttctgggccgtaactgacgctgaggcgcgaaagcgtggggagcaaacaggattagataccctggtagtccacgccgtaaacgatgaatgctaggtgtagggggtatcgaccccctctgtgccgcagctaacgcaataagcattccgcctggggagtacggccgcaaggttgaaactcaaaggaattgacgggggcccgcacaagcagcggagcatgttgtttaattcgacgcaacgcgaagaaccttaccagggcttgacatccaatggatcctgtggaaacacgggagtgcccttcggggaacattgagacaggtggtgcatggttgtcgtcagctcgtgtcgtgagatgttgggttaagtcccgcaacgagcgcaacccttatggtcagttgccagcacgtaaaggtgggaactctgacaagactgccgtggataacacggaggaaggtggggacgacgtcaaatcatcatgctccttatgtcctgggctacaaacgtgctacaatggccgtgacaaagggaagcgaacccgcaagggggagcggaaccgaaaaaagcggtctcagttcggattgtgggctgcaacccgcccacatgaagttggagttgctagtaatcgcggatcagaatgccgcggtgaatgcgttcccgggccttgtacacaccgcccgtcacaccatgggagttggtagcacccaaagccaatgagccaaccggaagggggcagctgtctaaggtgagacc

SEQ ID NO: 237 - DNA, 1450 bp, Artificial Sequence
  Synthetic Polynucleotide
gaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggattgcatgatccggtgtgaaaaactccggtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccgcgccgtaaacgatgaatactaggtgtcggggcacataagtgctccggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagtccggctgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaacttgactacatgaagctggaatcgctagtaatcgcagatcagaatgctgcggtgaatacgttcccgggtcttgtacacaccgcccgtcacaccatgggagtcggaaatgcccgaagtcggtgacctaatgtaagaaggagccgccgaaggcaggtctgataactggggt

SEQ ID NO: 238 - DNA, 1428 bp, Artificial Sequence
  Synthetic Polynucleotide
ctaacacatgcaagtcgaacggggttacactaggtgcttgcaccatgtggaacctagtggcggacgggtgagtaacgcgtgagcaacctgcctttcagagggggataacaacgggaaaccgttgctaataccgcatgataccggatgatggcatcatcgaccggtcaaaggagcaatccgctgaaagatgggctcgcgtcccattaggtagttggtggggtaaaggcctaccaagccgacgatgggtagccggactgaaaggttgatcggccactttggaactgacacacggcccaaactcctacgggaggcagcagtggggaatattgggaaatggggaaaaccctgacccagcaacgccgcgtggaggaaaaaggtcttcggattgtaaactcctgtccttagggaataaacaaatgacggtacctgatgaggaagctccggctaactacgtgccagcagccgcggtaatacgtagggagcgagcgttgtccggaattactgggcgtaaagggtgcgtaggcggtctgaaaagtcggatgtgaaatccccgtgcttaacatgggagctgcattcgaaactttcggacttgagtgtcggagaggtaagcggaattcccggtgtagcggtgaaatgcgtagatatcgggaggaacaccagtggcgaaggcggcttactggacgacaactgacgctgaggcacgaaagcgtggggagcaaacaggattagataccctggtagtccacgccgtaaacgatggatactaggtgtaggaggtaacacccctcctgtgccgcagccaacgcaataagtatcccgcctggggagtacgatcgcaagattgaaactcaaaggaattgacgggggcccgcacaagcagcggagcatgtggtttaattcgaagcaacgcgaagaaccttaccaagacttgacatcccttgacaggcatggaaacatgctttcccttcggggcaaggagacaggtggtgcatggttgtcgtcagctcgtgtcgtgagatgttgggttaagtcccgcaacgagcgcaacccttacacttagttaccagcgggtaaagccggggactctaagtggactgccggggacaactcggaggaaggtggggacgacgtcaaatcatcatgccccttatgtcttgggctacacacgtgctacaatggccgttacaaagagcagcgagagggtaacctggagcgaaactcaaaaaagcggtcccagttcggattgtgggctgcaacccgcccacatgaagtcggagttgctagtaatcgcggatcagcgtgccgcggtgaatgcgttcccgggccttgtacacaccgcccgtcacaccatgggagttgggagcacccgaagccggtgacttaaccgcaaggagagagccgtcgaaggtgagatcaataactagggtg

SEQ ID NO: 239 - DNA, 1467 bp, Artificial Sequence
  Synthetic Polynucleotide
gacgaacgctggcggcatgcctaacacatgcaagtcgaacggagactatttcggtagtcttagtggcgaacgggtgagtaacgcgtgggcaacctgccctctagatggggacaacatcccgaaaggggtgctaataccgaatgtgacggtttatccgcatggacgaaccgtgaaagatggcctctacatgtaagctatcgctagaggatgggcctgcgtctgattagctagttggtagggtaacggcctaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaaactcttttgtttatgacgaatgtgcagattgtgaataattatttgtaatgacggtagtaaacgaataagccacggctaactacgtgccagcagccgcggtaatacgtaggtggcgagcgttgtccggaattattgggcgtaaagagcatgtaggcggtttcttaagtctggagtgaaaatgcggggctcaaccccgtatggctctggatactgggagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggctgtaaacgatgggtactaggtgtaggaggtatcgacccctcctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgagtgaccgccatagagatatggctttcccttcggggacacgaaaacaggtggtgcatggctgtcgtcagctcgtgtcgtgagatgttgggttaagtcccgcaacgagcgcaacccctatcctatgttaccagcgggtaatgccggggattcataggagactgccaaggacaacttggaggaaggcggggatgacgtcaagtcatcatgccccttatgtcttgggctacacacgtactacaatggtcggcaacagagggaagagaagccgtgaggcagagcaaaccccagaaatccgatctcagtttggattgcaggctgcaactcgcctgcatgaagtcggaatcgctagtaatcgcaggtcagcatattgcggtgaatacgttcccgggccttgtacacaccgcccgtcacaccacgaaagttggtaacaccggaagccggtggggtaaccgaaaggagccagccgtctaaggtggggccgatgat

SEQ ID NO: 240 - DNA, 1389 bp, Artificial Sequence
  Synthetic Polynucleotide
ggcgaccggcgcacgggtgagtaacacgtatgcaacctgtccgtcacaggaggataagctggagaaattccacctaatactccataacactttccgggaacatccccgggaagtcaaaagaatttattccggtgacggatgggcatgcggtgcattatctagtctgcgccgtaacggcccaccgaggcgacgatgcgtaagggttctgagaggaaggtcccccacattgcaactgagacacggtccaaactcctacgggaggcagctagtgaggaatattggccaatgcgcagaaacctgaaccagtccaagttcggtgaaggaataacgccctcacggccgtaaacctcttttgccgcggagcaatggttcgcttgcgagcggacagggagagtacccggataacaatcatccgctaactccgtgccagcagccgcgtaaatacggaggatgcgagcgttatccggattttatgggtttaaagggtgcgtaggcggaccatcaagtcagcggtcaaaagtcggggctcaaccccgtaaagccgttgaaactggtggtcttgagtgagcgagaagcaggcggaatgcgtggtgtagcggtgaaatgcatagatatcacgcagaaccccgattgcgaaggcagcctgccggcgctcaactgacgctgaggcacgaaagtgcggggatcgaacaggattagataccctggtagtccgcacagtaaacgatgaatgctagctgtccgggtcgaatgagacctgggtggcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgccgcaggaatcacatctgaaaggaagtgagccagcaatggtctgcggcgaggtgctgcatggttgtcgtcagctcgtgccgtgaggtgtcggcttaagtgccataacgagcgcaacccctaccgacagttgctaactggtcaagcagaggactctgtcgggactgccggcgcaagctgtgaggaaggcggggatgacgtcaaatcagcacggcccttacgtccggggcgacacacgtgttacaatggcaggtacagagggaagccacctggcgacagggagcggaacccgaaaacctgtctcagttcggatcggagtctgcaacccgactccgtgaagctggattcgctagtaatcgcgcatcagccatggcgcggtgaatacgttcccgggccttgtacacaccgcccgtcaagccatgggagccgggggtgcctgaaggccgtgaccgcaaggagcggcctagggtaaaaccggtgactgg

SEQ ID NO: 241 - DNA, 1463 bp, Artificial Sequence
  Synthetic Polynucleotide
catgcctaacacatgcaagtcgaacggaggttacttcggtaatcttagtggcgaacgggtgagtaacgcgtgggcaacctgccctctagatggggacaacatcccgaaaggggtgctaataccgaatgtgacagcaatctcgcatggggatgctgtgaaagatggcctctatttataagctatcgctagaggatgggcctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcaggttgtgaataatgacttgtaatgacggtagtaaacgaataagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgctacgtgaagaaccttagcgaggcttgacattgaatgtccgcttcagagatgaagctttccattcggggacatgaaagcaggtggtgcatggctgtcgtcatcttgtgtcgtgagatgttggggtaattcccgtaacgagcgcaacccgtatcatatgttaccagcgggtaatgccggggactcataggagtctgccaaggacaacttggaggaaggcggggaaggcgtcaagtcatcatgctccttatgtcttgggctacacacgtaatacaatggtcggcaacagagggaagcgaagccgtgaggcagagcaaaccccagaatcccgatctcatttcggatttcaggctgcaattcgcctgcatgaagtcggaatcggtagtaatcgcaggtcagcattctgcggtgaatacgttcccgggctttgtacacaccgcccgtcacaccacgaaagttggtaacacccgaagccggtggggtaaccgtaaggagccagccgtctaaggtggggccgatgattggggtgaagt

SEQ ID NO: 242 - DNA, 1447 bp, Artificial Sequence
  Synthetic Polynucleotide
gcttaacacatgcaagtcgaacggagtttgtttttggaagccttcgggtggaagggaataaacttagtggcgaacgggtgagtaacgcgtgagcaaccggtcccaaagagggggacaactttgagaaatcaaggctaataccgcgtaagaccacactgccgcatggcagaggggtcaaaggagaaatccgctttggggagggctcgcgtcccattaggtagttggtgaggtaacggctcaccaagccgacgatgggtagccgtgctgagaggcaggccggccacactggaactgagacacggtccagactcctacgggaggcagcagtggggaatcttgggcaatggggggaaccctgacccagcgacgccgcgtgagggaagaaggtcttcggattgtaaacctttgtgacaggggacgaaggaagtgacggtaccctgagaggaagccccggctaactacgtgccagcagccgcggtaatacgtagggggcgagcgttgtccggaattactgggcgtaaagggcgcgtaggcggttgtgcaagtctgttgtgaaattccggggctcaactccggcagtgcaatggaaactgtacgacttgagtacggcagaggcaagtggaattcccagtgtagcggtgaaatgcacagagattgggaggaacaccagtggcgaaggcgacttgctgggccgaaactgacgctgaggcgcgaaagcgtggggagcaaacaggattagataccctggtagtccacgccgtaaacgatgaatactaggtgtaggtggtatagaagccatctgtgccgcagcgaacgcagtaagtattccgcctggggagtacggccgcaaggttgaaactcaaaggaattgacgggggcccgcacaagcagcggagcatgtggtttaattcgaagcaacgcgaagaaccttaccaggtcttgacatccgactaaagtcatagagatatgatgttccttcgggagagatcgagacaggtggtgcatggttgtcgtcagctcgtgtcgtgagatgttgggttaagtcccgcaacgagcgcaacccctacaaacagttgccagtgcgtaaaggcaggcactctgttaggactgccgtggacaacacggaggaaggtggggacgacgtcaaatcatcatgccccttatgacctgggctacacacgtgctacaatggctgttacaaagagaagcgaagtcgtaaggcggagcggatctcaaaaaggcagtcccagttcggattgtgggctgcaacccgcccacatgaagttggagttgctagtaatcgcgaatcagaatgtcgcggtgaatgcgttcccgggccttgtacacaccgcccgtcacaccatgggagtcgggggcgcccgaagccgctgaggtaacccgcaagggagccaggcgtcgaaggcgaaaccgatgactggggtgaagt

SEQ ID NO: 243 - DNA, 1435 bp, Artificial Sequence
  Synthetic Polynucleotide
gtgcttaacacatgcaagtcgaacgaggcatttaacacagattacttcgggttgaagtcttttatgactgagtggcggacgggtgagtaacgcgtgggtaacctgcctcatacagggggatagcagctggaaacggctggtaataccgcataagcgcacggtatcccatgatacaatgtgaaaaactccggtggtatgagatggacccgcgtctgattatctggttggtgaggtaacggcccaccaaggcgacgatcagtagccgacctgagagggtgaccggccacattgggactgatacacggcccagactcctacgggaggcatcaatggggaatattgcacaatggaggaaactctgatgcaccgacgccgcgtgagtgaacgaagtagttcgctatgtaaagctctatcaccagggaagatagggacggtacctgactaaaaagctccggctaaatacctgccaccagccgcggaaatacgtatggagcaagcgttatccggatttactgggtgtaaagggagtgtaggtggccaggcaagtcacaagtgaaagcccggggctcaaccccgggactgcttttgaaactgcagggctagagtgcaggaggggcaagtggaattcctagtgtagagctgaaatgcgtagatattaggaggaacaccagtggcgaacgcggcttgctggactgtaactgacactgaggctcgaaagcgtggggagcaaacaggattagataccctggtagtccacgccgtaaacgatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacacgaagaaccttaccaagtcttgacatcccactgaccggacagtaatgtgtccttcccttcggggcagtggagacaggtggtgcatggttgtcgtcagctcgtgtcgtgagatgttgggttaagtcccgcaacgagcgcaacccttattcttagtagccagcagttcggctgggcactctagggagactgccagggataacctggaggaaggtggggatgacgtcaaatcatcatgccctttatgacttgggctacacacgtgctacaatggcgtaaacaaagtgaagcaaagctgtgaagccaagcaaatcacaaaaataacgtctcagttcggattgtagtctgcaactcgactacatgaagctggaatcgctagtaatcgcagatcagaatggtgcggcgaatacgttcccgggtcttgtacactccgcccgtcacaccatgggagtcggaaatgcccgaagtcggtgacctaacgtaagaaggagccgccgaaggcaggtctgataactgg

SEQ ID NO: 244 - DNA, 1439 bp, Artificial Sequence
  Synthetic Polynucleotide
caggatgaacgctagcgacaggcctaacacatgcaagtcgaggggcagcggagaggtagcaatacctttgccggcgaccggcgcacgggtgagtaacacgtatgcaatccacctgtaacagggggataacccggagaaatccggactaataccccataatatgggcgctccgcatggagagcccattaaagagagcaattttggttacagacgagcatgcgctccattagccagttggcggggtaacggcccaccaaggcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtacgctacgcgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaatttccgggctcaacccggagtgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatgccggtgaaagtcggcagctagcaatagtcgcctgcgaggtgctgcatggttgtcgtcagctcgtgccgtgaggtgtcagcttaagtgccataacgagcgcaacccctattgacagttactaacgggtgaagccgaggactctgtcgagactgccggcgcaagccgcgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtaaatacgttcccgggccttgtacacaccgcccgtcaagccatgggagccgggggtacctgaagtgcgtaaccgcgaggagcgccctagggta

SEQ ID NO: 245 - DNA, 1421 bp, Artificial Sequence
  Synthetic Polynucleotide
tgaacgctagcggcaggcttaacacatgcaagtcggacggcagcggggtgaggggcttgcccctcctgccggcgagtggcgcacgggtgagtaacacgtatgcaacctgcccctgtcagggggacaacccgccgaaaggcgggctaagcccgcgtaaatcttctcaggggcatcctgaggagaggaaaggagtgatccggacagggatgggcatgcggcgcattaggcagttggcggggtaacggcccaccaaaccgacgatgcgtaggggttctgagaggaaggtcccccacactggtactgagacacggaccagactcctacgggaggcagcagtgaggaatattggtcaatgggcgggagcctgaaccagccaagccgcgtggaggaagaaggtacagagtatcgtaaactccttttgtcaggggataaaaggcgccacgtgtggcgttctgaaggtacctgaagaaaaagcatcggctaactccgtgccagcagccgcggtaatacggaggatgcgagcgttatccggatttattgggtttaaagggtgcgtaggcggcttttaagtcagttggtgaaagyctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgmtacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggacgagagccctctatagccgtttgcgaggtgctgcatggttgtcgtcagctcgtgccgtgaggtgtcggcttcaagtgccataacgagcgcaaccctgccgccagttrctaccattaggttgaggactctggcgggactgccaacgcaagttgcgaggaaggcggggatgacgtcaaatcagcacggcccttacgtccggggcgacacacgtgttacaatggtcggtacagcgggaagccacctggcgacagggagcggaacccgaaagccgacctcagttcggatcggagtctgcaacccgactccgtgaagctggattcgctagtaatcgcgcatcagccatggcgcggtgaatacgttcccgggccttgtacacaccgcccgtcaagccatgggagccgagggcgcttgaagtgcgtcgccgtgaggcgcgccctagagcgaaatcggtgactggggc

SEQ ID NO: 246 - DNA, 1448 bp, Artificial Sequence
  Synthetic Polynucleotide
gcggcatgctttacacatgcaagtcgaacggcaacgcggggagcttgctccctggcggcgagtggcgcacgggtgagtaatacatcggaacgtgtcttctagtgggggataactgcccgaaagggcagctaataccgcatgaaacctgagggtgagagcgggggatcgcaagacctcgcgctggaagagcggccgatgtccgattaactagttggtgaggtaaaggctcaccaaggcgacgatcggtagctggtctgacaagacgaccagccacactgggactgatacacggcccagactcctacgggaggcaccagtggggaattttggacaatgggggcaaccctgatccagccatgccgcgtgcaggatgaaggtcttcggattgtaaactgcttttgtcacggacgaaaagggatgcgataacaccgcattccgctgacggtacctgaagaataagcaccagctaactacgtgccagcagccgcggtaatacgtagggtgcaagcgttaatcggaattactgggcgtaaagcgtgcgcaggcgggcctgtaagattgatgtgaaatccccgggctcaacctgagaattgcatatatgactgcacgacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaaggtctgagagatcagaccgtgcccgcaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccaggggagtggggttcaccagaagacgtttgcccaaccgaaaggaaggcggcgtccacggtgggcttcatgactggggtgaa

SEQ ID NO: 247 - DNA, 1487 bp, Artificial Sequence
  Synthetic Polynucleotide
ctggcggcgtgcttaacacatgcaagtcgaacgaagcactttatttgatttccttcgggactgattattttgtgactgagtggcgaacgggtgagtaacgcgtaggcaacctgccctttagacggggacaacattccgaaaggagtgctaataccggatgtgatcatcgtgccgcatggcaggatgaagaaagatggcctctacaagtaagctatcgctaaaggatgggcctgcgtctgattagctagttggtagtgtaacggactaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggatttcggtctgtaaagctctgttgtttatgacgaacgtgcagtgtgtgaacaatgcattgcaatgacggtagtaaacgaggaagccacggctaactacgtgccagcagccgcggtaatacgtaggtggcgagcgttgtccggaattattgggcgtaaagagcatgtaggcggcttaataagtcgagcgtgaaaatgcggggctcaaccccgtatggcgctggaaactgttaggcttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaaggcttgacattgattgaacgctctagagatagagatttcccttcggggacaagaaaacaggtggtgcatggctgtcgtcagctcgtgtcgtgagatgttgggttaagtcccgcaacgagcgcaacccctatcctatgttaccagcaagtaaagttggggactcatgggagactgccagggacaacctggaggaaggcggggatgacgtcaagtcatcatgccccttatgtcttgggctacacacgtactacaatggtcggaaacagagggaagcgaagccgcgaggcagagcaaaccccagaaacccgatctcagtttggatcgcaggctgcaacccgcctgcgtgaagtcggaatcgctagtaatcgcaggtcagcgtactgcggtgaatacgttcccgggccttgtacacaccgcccgtcacaccacgaaagttggtaacacccgaagccggtgaggtaacctattaggggccagccgtctaaggtggggccgatgattg

SEQ ID NO: 248 - DNA, 1445 bp, Artificial Sequence
  Synthetic Polynucleotide
gaacgctagcgacaggcctaacacatgcaagtcgaggggcaacaggtatcagcttgctgatacgctggcgaccggcgcacgggtgagtaacgcgtatgcaatctacctgtaacagggggataacccggagaaatccggcctaataccccataacgatacctatccgcatgaataggcatctaaaggatttccggttacagatgagcatgcgttccattagctagttggcggggtaacagcccaccaaggcgacgatggataggggttctgagaggaaggtcccccacactggtactgagacacggaccagactcctacgggaggcagcagtgaggaatattggtcaatgggcgaaagcctgaaccagccaagtcgcgtgaaggaagacagccctacgggtcgtaaacttcttttgtatgagagtaaaagaggtcacgtgtgacctattgcaagtaccatacgaataagcatcggctaactccgtgccagcagccgcggtaatacggaggatgcgagcgttatccggatttattgggtttaaagggtgcgtaggcggccctataagtcagcggtgaaaattttcggctcaaccgggaaagtgccgttgaaactgtagagctagagtacacaagaggtatgcggaatgcgtggtgtagcggtgaaatgcatagatatcacgcagaaccccgattgcgaaggcagcatactggggtgaaacagacgctgaagcacgaaagcgtgggtatcgaacaggattagataccctggtagtccacgccgtaaacgatgaatactaactgtttgcgatatacagtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcaggcggaatacgtatgaaagtacgtagctagcaatagtctcctgcgaggtgctgcatggttgtcgtcagctcgtgccgtgaggtgtcggcttaagtgccataacgagcgcaacccttatcgatagttactaccaggtaaagctgaggactcaatcgagactgccagcgtaagctgcgaggaaggtggggatgacgtcaaatcagcacggcccttacgtccggggcgacacacgtgttacaatggcagggacaacgagtagccaagcagtaatgccgcgccaatctccaaaccctgtcccagttcggatcggagtctgcaactcgactccgtgaagctggattcgctagtaatcgcgcatcagccatggcgcggtgaatacgttcccgggccttgtacacaccgcccgtcaagccatgggagccgggagtacctgaagtatgcaaccgcaaggagcgtcctagggtaatactggtgactgggg

SEQ ID NO: 249 - DNA, 1345 bp, Artificial Sequence
  Synthetic Polynucleotide
ggacgaacgctggcggcgtgtttaacacatgcaagtcgaacggagagtaccaagtagcaatacgcggtattcttagtggcggacgggtgagtaacgcgtgagcaatttgccttagggtggaggataacagcgggaaaccgttgctaataccgcatatgactacggccgggcatccggttgtggtgagaggagcaatccgcccttagatgagctcgcgtcccattaggtagttggcggggtaacggcccaccaagcctgcgatgggtagccggactgagaggttggccggccacactggaactgagacacggtccagactcctacgggaggcagcagtgaagaatattgggcaatgggggaaaccctgacccagcaacgccgcgtgagggaagaaggttctcggattgtaaacctctgtcccatgggaagaaaaaaatgacggtaccatgggaggaagccccggctaactacgtgccagcagccgcggtaatacgtagggggcaagcgttgtccggaattattgggcgtaaagggtgcgtaggcggcccatcaagttggatgtgaaatccccgtgcttaacatgggaattgcattcaaaactgaagggcttgagtgtggaagaggtaagtggaattcccagtgtagcggtgaaatgcgtagatattgggaggaacaccagtggcgaaggcgacttactgggccacaactgacgctgaggcacgaaagcgtggggagcaaacaggattagataccctggtagtccacgctgtaaacgatgattactaggtgtagggggtaacaccccccctgtgccgcagctaacgcaataagtaatccgcctggggagtacggtcgcaagattgaaactcaaaggaattgacgggggcccgcacaaacagcggagcatgtggtttaattcgaagcaacgcgaagaaccttaccaaggcttgacatcctctgaccgccgtggaaacacggaatcccttcggggcagagagacaggtggtgcatggttgtcgtcagctcgtgtcgtgagatgttgggttaagtcccgcaacgagcgcaacccttacacttagttaccagcgggtaaagccggggactctaggtggactgccggggacaactcggaggaaggtggggacgacgtcaaatcatcatgccccttatgtcttgggctacacacgtgctacaatggccgctacaaagagcagcaagggcgtaagccggagcgaaactcataaaagcggtcccagttcggattgtgggctgcaacccgcccacatgaagtcggagttgctagtaatcgcggatcagcatgccgcggtgaatgcgttcccgggcc

SEQ ID NO: 250 - DNA, 1434 bp, Artificial Sequence
  Synthetic Polynucleotide
gtgcctaacacatgcaagtcgagcgagaagccattgactgaaacttcggtagaaggatatggtggaaagcggcggacgggtgagtaacgcgtaggcaacctgccccttacagagggatagccattggaaacgatgattaaaacctcataacgcatccccctcacatggaggggatgccaaagattcatcggtaagggatgggcctgcgtctgattagctagttggcggggtaacggcccaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagggatgaaggccttcgggtcgtaaacctctgtccttggggaagaaacaaatgacggtacccatggaggaagccccggctaactacgtgccagcagccgcggtaatacgtagggggcgagcgttatccggaattattgggcgtaaagagtgcgtaggtggttacctaagcgcagggtctaaggcaatggctcaaccattgttcgccctgcgaactgggctacttgagtgcaggagaggaaagcggaattcctagtgtagcggtgaaatgcgtagatattaggaggaacaccagtggcgaaggcggctttctggactgttactgacactgaggcacgaaagcgtggggagcaaacaggattagataccctggtagtccacgccgtaaacgatgagcactaggtgtcggggccgcaaggcttcggtgccgcagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatcccactgacagatccctaaccggatccttcttcggacagtggagacaggtggtgcatggttgtcgtcagctcgtgtcgtgagatgttgggttaagtcccgcaacgagcgcaacccttgccattagttgccatcattcagttgggcactctaatgggactgccggggacaactcggaggaaggtggggatgacgtcaaatcatcatgccccttatgttctgggctacacacgtgctacaatggccggtacagcaagaagcaaaaccgcgaggtggagcaaatctcaaaaaccggtcccagttcggactgcaggctgaaacccgcctgcacgaagccggagttgctagtaatcgtggatcagaatgccacggtgaatgcgttcccgggtcttgtacacaccgcccgtcacaccatgggagtcagtaacgcccgaagtcagtgaccgaaccgaaaggacggagctgccgaaggcgggacggatgactggggcga

SEQ ID NO: 251 - DNA, 1446 bp, Artificial Sequence
  Synthetic Polynucleotide
gcggcgtgcttaacacatgcaagtcgaacttagcatttacgacagatttcttcggattgaagttgtttatgactgagtggcggacgggtgagtaacgcgtgggtaacctgcctcatacagggggatagcagctggaaacggctggtaataccgcataagcgcacggtatcgcatgatacggtgtgaaaaactccggtggtatgagatggacccgcgtctgattagctggttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacaccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccgtggtagtgcacgccgtaaacaatgaatactaggtgtcggggcacataagtgcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtccttcccttcggggcagtggagacaggtggtgcatggttgtcgtcagctcgtgtcgtgagatgttgggttaagtcccgcaacgagcgcaacccttattcttagtagccagcagttcggctgggcactctagggagactgccagggataacctggaggaaggtggggatgacgtcaaatcatcatgccccttatgaccagggctacacacgtgctacaatggcgtaaacaaagggaagcgaacctgtgaggggaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagtcagtaacgcccgaagtcagtgacccaaccgtaaggagggagctgccgaaggtgggaccgataactggggtga

SEQ ID NO: 252 - DNA, 1451 bp, Artificial Sequence
  Synthetic Polynucleotide
tggctcaggacgaacgctggcggcatgcctaacacatgcaagtcgaacggagattatttcggtaatcttagtggcgaacgggtgagtaacgcgtgggcaacctgccctctagatggggacaacatcccgaaaggggtgctaataccgaatgtgacagcaatctcgcatgagaatgctgtgaaagatggcctctatttataagctatcgctagaggatgggcctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaagaattcgttccgtaaagctcttttgtttatgacgaatgtgcagattgtgaacaatgatctgtaatgacggtagtaaacgaataagccacggctaactacgtgccagcagccgcggtaatacgtaggtggcgagcgttgtccggaattattgggcgtaaagagcatgtaggcggttttttaagtctggagtgaaaatgcggggctcaaccccgtatggctctggatactggaagacttgagtgcaggagaggaaaggggaattcccagtgtagcggtgaaatgcgtagatattgggaggaacaccagtggcaaaggcgcctttctggactgtgtctgacgctgagatgcgaaagccagggtagcgaacgggattagataccccggtagtcctggccgtaaacgatggggtactaggtgtaggaggtatcgacccctttctgtgccggatctaacgcaataagtacaccacttggggagtaagttcgcaaggatgaaagtcaaaggaattgacgggggtcctcacaagcggtggagtatgtggtttaatttgaagcaacgcgaagatcgtttccaaggcttgacattgaatgaccgcatcagagaagaagctttccattcggggacatgaaaacaggtggtgcatggaggtcgtcagattgtgtcgtgagatgatgggttaagtcgcgcaacgagcgcaacccatatcatatgttaccagcgggtaatgccgcggagtcataggagactgccaaggacaacttggaggaaggcggggaggatgtcaagtcatcatgcgcggtcatgtcttgtgggtacacacgtactacaatggtcggcaacagagggaagcgaagcagtgaggcagagcaaaccccagaaatccgatatcagttctgattgcaggatgcaactcgcgatgcatgaagtcggaatggttagtaatcgcaggtcagcatattgcggtgaatacgttcccgggccttgtacacaccgcccgtcacaccacgaaagttggtaacacccgaagccggtggggtaaccgtaagg

SEQ ID NO: 253 - DNA, 1428 bp, Artificial Sequence
  Synthetic Polynucleotide
gctggcggcgtgcctaacacatgcaagtcgagcgagaagccttagacggacacttcggtagaagtttgaggtggaaagcggcggacgggtgagtaacgcgtaggcaacctgccctttgcggagggatagcctcgggaaaccgggattaaaacctcataacgccttggagccgcatggcggcgaggccaaagatttatcggcaaaggatgggcctgcgtctgattagttagttggtggggtaacggcccaccaaggcgacgatcagtagccgacctgagagggtgaacggccacattggaactgagacacggtccaaactcctacgggaggcagcagtggggaatattgcgcaatgggggaaaccctgacgcagcaacgccgcgtgagcgaggaaggcctttgggtcgtaaagctctgtcctcagggaagaaggaagtgacggtacctgaggaggaagccccggctaactacgtgccagcagccgcggtaatacgtagggggcgagcgttatccggaattattgggcgtaaagagtacgtaggcggtttcttaagcgcagggtttaagactatggcttaactatagttcgccctgtgaactgggagacttgagtatcggagaggaaagcggaattcctagtgtagcggtgaaatgcgtagatattaggaggaacaccagtggcgaaggcggctttctggacgaaaactgacgctgaggtacgaaagcgtggggagcgaacaggattagataccctggtagtccacgccgtaaacgatgagcactaggtgtcggggtcgcaagacctcggtgccggagttaacgcattaagtgctccgcctggggagtacgcgcgcaagcgtgaaactcaaaggaattgacggggacccgcacaagcagcggagcatgtggtttaattcgaagcaacgcgaagaaccttaccagggcttgacatcctcctgacagggccttaatcggcccgttctacggacaggagagacaggtggtgcatggttgtcgtcagctcgtgtcgtgagatgttgggttaagtcccgcaacgagcgcaacccttgtcgttagttactaacattcagttgaggactctaatgagactgccgtggataacacggaggaaggtggggatgacgtcaaatcatcatgccccttatgtcctgggctacacacgtgctacaatggtcggcacagagagaggcgagaccgcgaggtggagcaaatctcaaaaaccgatcccagttcggatcgcgggctgcaactcgcccgcgtgaagtcggagttgctagtaatcgcggatcagaacgccgcggtgaatgcgttcccgggtcttgtacacaccgcccgtcacaccatggaagttgggggcgcccgaagtcggctaggaaataggctgcctaaggtgaaaccaatgactgg

SEQ ID NO: 254 - DNA, 1454 bp, Artificial Sequence
  Synthetic Polynucleotide
aacgctggcggcgtgcttaacacatgcaagtcgaacgaagcatttaagacggattctttcgggatgaagacttttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggactagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgcccggtcagtaatgtgaccttttcttcggaacaagagtgacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttacgatttgggctacacacgtgctacaatggcgtaaacaaagagaagcgagcctgcgagggggagcaaatctcaaaaataacgtctcagttcggattgtagtctgcaactcgactacatgaagctggaatcgctagtaatcgcagatcagaatgctgcggtgaataggttcccgggtcttgtacacaccgcccgtcacaccatgggagtcggaaatgcccgaagccagtgacccaagcgaaagcagggagctgtcgaaggcaggtctgataactggggtga

SEQ ID NO: 255 - DNA, 1442 bp, Artificial Sequence
  Synthetic Polynucleotide
aggatgaacgctggcggcgtgcctaacacatgcaagtcgagtgagaaattaatcaatgaatcttcggaagaattgattaatggaaagcggcggacgggtgagtaacgcgtgggcaacctgcctttcacagagggatagccaaaggaaactttgattaaaacctcataaagctggaatagtgcataatataccagccaaagatttatcggtgaaagatgggcccgcgtctgattagctagttggtggggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaacgaagaaggccttcgggtcgtaaagttctgtccaaagggaagaaaagaatgacggtacctatggaggaagccccggctaaatacgtgccagcagccgcggtaatacgtatggggcaagcgttatccggaattattgggcgtaaagagtgcgtaggtggtggcttaagcgcagggtttaaggcaatggcttaactattgttcgccttgcgaactgggtcacttgagtacaggagaggaaagcggaattcctagtgtagcggtgaaatgcatagatattaggaggaacaccggtggcgaaggcggctttctggactgcaactgacactgaggcacgaaagcgtgggtagcaaacaggattagataccttggtagtccacgccgtaaacgatgagcactaggtgtcggccaataaaggtcggtgccgcagttaacgcattaagtgctccgcctggggagtacgcacgcaagtgtaaaactcaaaggaattgacggggacccgcacaagcagcggagcatgtggtttaattcgaagcaacgcgaagaaccttaccagagcttgacatccctctgacagatccttaatcggatttttcttcggacagaggagacaggtggtgcatggttgtcgtcagctcgtgtcgtgagatgttgggttaagtcccgcaacgagcgcaacccttatcattagttgccatcattaagttgggcactctagtgagactgccggggacaactcggaggaaggtggggatgacgtcaaatcatcatgccccttatgttctgggctacacacgtgctacaatggtcggtacagaaagcagcgaaaccgtgaggtgaagccaatctccaaaaccgatctcagttcggattgtaggctgcaactcgcctacatgaagtcggagttgctagtaatcgcagatcagaatgctgcggtgaatgcgttcccgggtcttgtacacaccgcccgtcacaccatggaagttgggggtgcccgaagttggacaacaaatcgtttacctaaggcaaaaccaatgactggggtgaag

SEQ ID NO: 256 - DNA, 1579 bp, Artificial Sequence
  Synthetic Polynucleotide
tggctcaggacgaacgctggcggcgtgcttaacacatgcaagtcgaacggaattacgcttaacaccgattcttttatagaaggtgcaatgcgaagacgcgatgcggtgaatgaacgaagtgaattcaccacgcattaaaaaagtgcaaacaccaagaggaatgggtgttgagcgtaatttagtggcgaacgggtgagtaacgcgtagacaacctaccttttagatggggacaacatcgcgaaagcggtgctaataccgaatgttgataatgaaatgcatgtttcgttatttaaagatggcctctatatataagctatcgctaaaagatgggtctgcgtctgattagctagttggtgagataacagcccaccaaggcaacgatcagtagccggtctgagaggatgaacggccacattgggactgagacacggcccaaactcctacgggaggcagcagtggggaatcttccgcaatggacgaaagtctgacggagcaacgccgcgtgagtgaagaaggttttaggatcgtaaagctctgttgtttaggacgaatgtgccttatgcgaatagtatgaggtaatgacggtactaaacgagaaagccacggctaactacgtgccagcagccgcggtaatacgtaggtggcaagcgttgtccggaattattgggcgtaaagggagcgcaggtgggaaaataagtctgttttaaaagtgcggggctcaaccccgtgatggaatggaaactgtttttcttgagtgcaggagaggaaagtggaattcctagtgtagcggtgaaatgcgtagatattaggaggaacaccagtggcgaaggcgactttctggactgtaactgacactgaggctcgaaagccagggtagcgaacgggattagataccccggtagtcctggccgtaaacgatgggtactaggtgtaggaggtatcgaccccttctgtgccggagttagcgcaataagtaccccgcctggggagtacggccgcaaggttgaaactcaaaggaattgacgggggcccgcacaagcggtggagtatgtggtttaattcgacgcaacgcgaagaaccttaccagggcttgacattgattgaaagacgtagagatacgtacctcttcttcggaagacaagaaaacaggtggtgcatggctgtcgtcagctcgtgtcgtgagatgttgggttaagtcccgcaacgagcgcaacccctatcatttgttgccagcacgtaaaggtgggaactcaaatgagactgccgcggataacgcggaggaaggcggggatgacgtcaagtcatcatgccccttatgtcctgggctacacacgtactacaatgggattgacagagggaagcgaaatcgcgagatggagcaaaccccagaaacaatctctcagttcggattgtaggctgcaactcgcctacatgaagtcggaatcgctagtaatcgcaggtcagcatactgcggtgaatacgttcccgggccttgtacacaccgcccgtcacaccacgaaagtcagtcacacccaaagccggtggggtaactctaacgagagctagccgtctaaggtgg

SEQ ID NO: 257 - DNA, 1447 bp, Artificial Sequence
  Synthetic Polynucleotide
gcgtgcttaacacatgcaagtcgaacgaagcatttaagacggattctttcgggatgaagacttttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagccagtgacccaaccttttggagggagctgtcgaaggtggagccggtaactggggtgaagtc

SEQ ID NO: 258 - DNA, 1437 bp, Artificial Sequence
  Synthetic Polynucleotide
cttaacacatgcaagtccaacgaagcatttgcgactgatttcttcggattgaagttgcttatgactgagtggcggacgggtgattaacgcgtgggtaacctgcctcacacagggggatagcagtagaaaacggctgataataccgcataagcgcacagtaccgcatggtacagtgtgaaaaactccggtggtgtgagatgcacccgcgtctgattagcttgttggccggctaacggcctaccaaggcaacgatcagaaaccgacctgagagggtgaccggccacattgggactgacacacctcccagactcctacgggaggcaacagtggggaatattgcacaatggaggaaactctgatgcagcgacaccgcgggagtgaagaagtaattcgttatgtaatagctctatcagcagggaagagaatgacggtacctgactaataaactccggcaaaatacatgccagcagccccggtaatacgtatggagcaagcgttatccggatttactgattgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacaccctcttgcccggtcagtaatgtgaccttttcttcggaacaagagtgacaggtggtgcatggttgtcgtcagctcgtgtcgtgagatgttgggttaagtcccgcaacgagcgcaacccctattcttagtagccagcatttaaggtgggcactctaggaagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcggtgacctaacgaaagaaggagccgccgaaggcaggtctgataactggggtga

SEQ ID NO: 259 - DNA, 1509 bp, Artificial Sequence
  Synthetic Polynucleotide
gagtttgatcctggctcaggatgaacgctggcggcgtgcctaacacatgcaagttgagcgagaaatcacttaaagaagcttcggtagacttaagagatggagagcagcggacgggtgagtaacgcgtgggaaacctgcccttgacaggaggatagccgagagaaatttcgattaatacttcataaagcagagcattcgcatggatgaactgccaaagaattatcggtcaaggatggtcccgcgtctgattagctggttggtaaggtagcggcttaccaaggcgacgatcagtagccggcctgagagggtgaacggccacattggaactgagacacggtccagactcctacgggaggcagcagtggggaatattgcacaatgggcgaaagcctgatgcagcaacgccgcgtgaaggaagaaggctttcgagtcgtaaacttctgtccaaagggaagaataatgacggtacctttgaagaaagccccggctaactacgtgccagcagccgcggtaatacgtagggggcgagcgttatccggaattactgggcgtaaagagtatgtaggtggttaagtaagcgtagggtttaaggcgacagcccaactgtcgtatgccccgcgaactgtttaacttgagtacaggaggggaaggcggaattcctagtgtagcggtgaaatgcgtagatattaggaggaacaccagtggcgaaggcggccttctggactgtaactgacactgagatacgaaagcgtgggtagcaaacaggattagataccctggtagtccacgccgtaaacgatgagcactaggtgtcgggctcgcaagagttcggtgccggagcaaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatcccactgaaagctcgggtaaagctgagcccttcttcggaacagtggagacaggtggtgcatggttgtcgtcagctcgtgtcgtgagatgttgggttaagtcccgcaacgagcgcaacccttgccgttagttgccatcattaagttgggcactctaatgggactgccggggagaacccggaggaaggcggggatgacgtcaaatcatcatgccccttatgttctgggctacacacgtgctacaatggccgtcacagagggaagcgagagagcgatcttaagcgaaaccaaaaaggcggtcccagttcggactgcaggctgcaactcgcctgcacgaagccggagttgctagtaatcgcggatcagaatgtcgcggtgaatgcgttcccgggtcttgtacacaccgcccgtcacaccatggaagttgggggtgcccaaagtcggtcaagaaaaggtcgcctaaggcaaaaccaatgactggggtgaagtcgtaacaaggtagccgtatcggaaggtgcggctggatcacctcctt

SEQ ID NO: 260 - DNA, 1421 bp, Artificial Sequence
  Synthetic Polynucleotide
gctttacacatgcaagtcgaacggtaacgtggggaggagcttgctccaccccgacgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagcctgttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacatcttcgaataaaggatgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccctaaaggatgttaactagttgttgggatgtaacaatctcagtaacgcagccaacgcgagaagttaaccgcttgggaagtacggtggcaagaataaaactcaaaggaattgacggggacccgcacaagcggtggatgatgtggattaattggatgcaacgcgaaaaaccttacttacccttgacatgtcaggaagcttttgtaatgagagcgtgcctgcaagggagcatgcacacaggtgctgcatggctgttgtcagctagtgtcgtgagatgttgggttaagtcctgcaacgagcgcaacccttgtcattaggtgttacgaaagggcactctagtgagtctgccggtgacaaaccggaggaaggtggggatgacgtcaagtcatcatggcccttatgggttgggcttcacacgtcatacaatggtcggaacagagggcagcgaagccgtgaggtggagccaatcccagaaatccgatcgtagtctggattgcagtctgcaactcgggtgcatgaagtcgcgatatcggtagtaatcgcggatcagcatgccgcggtgaatacgttcccgggtcttgtacacaccgcccgtcaaacaatgggagtggtgtttaccagaagtcgttagcctaaccgcaaggagggcggcg

SEQ ID NO: 261 - DNA, 1452 bp, Artificial Sequence
  Synthetic Polynucleotide
ggcggaacgctttacacatgcaagtcgaacggtaacgtggggaggatgttgctccaccccgacgacgagtggggaacgggtgagtagtacatcggaacgtggccgctcgtgggggacagccagccgaaaggttggctaataccggatgagttctacggaagaaagagggggacccgcaagggcctctcacgagcggagcggccgatgactgattagccggttggtgaggtaacggctcaccaaagcaacgatcagtagctggtctgagaggacgaccagccacactgggactgacacacggcccacactcctacgggaggcagcagtggggaattttggacaatgggcgcaagcctgatccagctattccgcgtgtgggatgaaggccctcgggttgtaaaccacttttgtagagaacgaaaagacatcttctaataaaggatgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaacgcagtctcctgagacataactgacgctcaggcacgaaagcgtgaggagcatacaggattagataccctgctagtccacgcccctaacgatgttaagtagtgtgttgggatgtaacaatctcagtaaggcagccaacgcgagaagttaaccgccctgggaagtacggtcgcaagactaaaactcaaaggaattgaccgcgacccgcacagcgggtggatgatgtggattaattcgatgcaacgcgacaaaccttactctacccttgacatgtcaggaagctgtagtaatgagagcgcgtccgcaagggagcatgaacacaggtggtgcatggttgtcgtcagctcgtgtcgtgagatgttggtttaagtcccgcaacgagccgcaatccttgtcactagttggtatgaaagggcactctagtgagactgccggtgacaaaccggaggaaggtggggatgacgtcaagtcctcatggcccttatgggtagggcttcccccgtcattcaatggtcggaacagagggcagggaagctgtgaggagcagccaatcccagaaaaccgattgtagttcggattgcagtttgcaacttggctgcatgaagttggaatcggtagtaattgcggatcagcatgccgcggtgaatacgttcccgggtcttgtaccccccccccgtcaaccactgggagtggtgtttcccagaagtcgttagcctaaccgcaaggagggcggcgaccccggtgagcaccgtgact

SEQ ID NO: 262 - DNA, 1458 bp, Artificial Sequence
  Synthetic Polynucleotide
gattgaacgctggcggcatgctttacacatgcaagtcgaacggcagcatagagagcttgctctctgatggcgagtggcgaacgggtgagtaatacatcggaacgtgtcctgttgtgggggataactactcgaaagagtagctaataccgcataagacctaagggtgaaagcgggggaccgaaaggcctcgcgcagttggagcggccgatgactgattagctagttggtggggtaaaggcctaccaaggcgacgatcagtagctggtctgagaggacgaccagccacattgggactgagacacggcccaaactcctacgggaggcagcagtggggaattttggacaatgggggcaaccctgatccagccatgccgcgtgcgggaagaaggccttcgggttgtaaaccgcttttgttaggaacgaaaaggtttctgtgaacaacagagattgctgacggtacctaaagaataagcaccggctaactacgtgccagcagccgcggtaatacgtagggtgcgagtgttaatcggaattactgggcgtaaagcgtgcgcaggcggttgggtaagacagatgtgaaatccccgagcttaacttgggaactgcatttgtgactgcctaactagagtatgtcagagggaggtggaattccaagtgtagcagtgaaatgcgtagatatttggaagaacaccgatggcgaaggcagcctcctgggataatactgacgctcatgcacgaaagcgtggggagcaaacaggattagataccctggtagtccacgccctaaacgatgtcaactagttgttgggccgcatggcttagtaacacagctaacgcgagaagttgaccgccgggggagtacggtcgcaagattaaaactcaaaggaattgacggggacccgcacaagcggtggatgatgtggattaattcgatgcaacgcgaaaaaccttacctagccttgacatgccaggaatcctgatgaaagtcgggagtgcccgcaagggaatctggacacaggtgctgcatggctgtcgtcagctcgtgtcgtgagatgttgggttaagtcccgcaacgagcgcaacccttgtcactagttgctacgcaagagcactctagtgaaactgccggtgacaaaccggaggaaggtggggatgacgtcaagtcctcgtggcccttatggctagggcctcacacgtcatacaatggtcggaacagagggcagcgaagccgcgaggcggagccaatcccagaaaaccgatcgtagtccggattgcactctgcaactcgagtgcatgaagtcggaatcgctagtaatcgcggatcagcatgccgcggtgaatacgttcccgggtcttgtacacaccgcccgtcacaccatgggagtggggttcaccagaaggcgtttgcctaaccttcgggagggcggcgaccacggtgggtttcatgactggggtgaa

SEQ ID NO: 263 - DNA, 1396 bp, Artificial Sequence
  Synthetic Polynucleotide
gacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaaacctgatccagctattccgcgtgtgggatgaaggccctcgggttgtaaaccacttttgtagagaacgaaaagacatcttcgaataaaggatgttgctgacggtactctaagaataagcaccggctaactacgtgccagcagccgcggtaatacgtagggtgcgagcgttaatcggaattactgggcgtagagggtgcgcaggcggttgagtaagacagatgtgaaatccccgagcttaactcgggaatggcatatgtgactgctcgactagagtgtgtcagaggggggtggaattccacgtgtagcagtgaaatgcgtagatatgtggaagaacaccgatggcgaaagcagcctcctgggacataactgacgctcaggcacgaaaggcgtggggagcaaacaaggattagaataccgtggggattccacggcctaaaggatgttaaatgagttgttgggagggggccgtctcagaaaggccgcccacggcgagaaagttaaccccctggggaagtacggtggcaagactaaaaactcaaaaggaattgacggggaccggcacaagcggtgggatgatgtggattaattcgatgcaacgcgaaaaaccttacttacccttgacatgtcaggaagctcttgtaatgagagcgtgcccgcaagggagcctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagcgaagccgtgaggcggagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcaaacaatgggagtggtgtttaccagaagtcgttagcctaaccgcaaggagggcggcgaccacggtgagcaccgtgact

SEQ ID NO: 264 - DNA, 1344 bp, Artificial Sequence
  Synthetic Polynucleotide
gacgaacgctggcggcgtgcctaacacatgcaagtcgagcggaagtatttgaggagcttgctttttggatactttagcggcggacgggtgagtaacgcgtgagtaacctggcctgtacagggggataacagttagaaatgactgctaataccgcataagaccacagtaccgcatggtacaggggtcaaagatttatcggtacaggatggactcgcgtcccattagctagttggcgggataacagcccaccaaggcgacgatgggtagccgacctgagagggtgatcggccacactgggactgagacacggcccagactcctacgggaggcagcagtggggaatattgggcaatgggcgcaagcctgacccagcaacgccgcgtgaaggaagaaggtcttcggattgtaaacttttgtcgccgggaacgataatgacggtacccggtaagaaagccccggctaactacgtgccagcagccgcggtaatacgtagggggcgagcgttgtccggaattactgggcgtaaagggcgcgtaggcggccggataagttagatgtgaaatccccgggctcaacctgggtgttgcatttaaaactgtctggcttgagtgcaggagaggaaagcggaattcctagtgtagcggtgaaatgcgtagatattaggaggaacatcagtggcgaaggcggctttctggactgtaactgacgctgaagcgcgagagcgtggggagcaaacaggattagatgccctggtagtccacgccgtaaaggatgaatactaggtgtaggggggtatcgaccccctctgtgcgcgcagcaaacgcaataagtattcccgcctggggagtacggccgcaaggttgaaactcaaaggaattgacgggggcccgcacaagcagcggagcatgtggtttaattcgacgcaacgcgaagaaccttaccaagacttgacatcctctgccgcatatagagagatgtgttcccttgggggcagagagacaggtggtgcatggttgtcgtcagctcgtgtcgtgagatgttgggttaagtcccgcaacgagcgcaacccttgtgaacagttgccagtattaagctaggaactgtgttcagactgccgtggacaacacggaggaaggtggggacgacgtcaaatcatcatgccccttacgtcttgggctacacacgtgctacaatggccgtaacagagggcagcgaaagggcaacctggagcgaatctcaaaaaaacggtctcagttcagattgtgggctgcaacccgcccacatgaagacggagttgctagtaatcgcggatcagcatgccgcggtgaatgcgttcccgggcct

SEQ ID NO: 265 - DNA, 1526 bp, Artificial Sequence
  Synthetic Polynucleotide
gagtttgatcctggctcaggacgaacgctggcggcgtgcttaacacatgcaagtcgaacgagacgatttagaagcttgcttttaatgagtcgagtggcaaacgggtgagtaacgcgtagacaacctgccgcaaagatggggacaacagtccgaaaggactgctaataccgaatgttgtatctcctccgcatggggaagatattaaagatggcctctacttgtaagctatcgctttgcgatgggtctgcgtctgattagctagttggtggggcaacggcctaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaaggtcttcggatcgtaaagctctgttgtcggggacgaatgtggaggttgtgaataacagcttccaatgacggtacctgacgaggaagccacggctaactacgtgccagcagccgcggtaatacgtaggtggcgagcgttgtccggaattattgggcgtaaagggagcgcaggcgggaggtcaagtctatcttaaaagtgcggggctcaaccccgtgaggggatggaaactggtcttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaagagctagagatagctccctctcttcggagacacgaaaacaggtggtgcatggctgtcgtcagctcgtgtcgtgagatgttgggttaagtcccgcaacgagcgcaacccctatcctttgttgccagcacgtaatggtgggaactcaaagaagactgccgcggacaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggcaggctaaccgcaaggaggcagccgtctaaggtgggggcgatgactggggtgaagtcgtaacaaggtaaccgta

SEQ ID NO: 266 - DNA, 1481 bp, Artificial Sequence
  Synthetic Polynucleotide
agagtttgattatggctcaggatgaacgctggcggcgtgcctaacacatgcaagtcgagcgagaaactcacgacggatacttcggttgaaggaatgagtggaaagcggcggacgggtgagtaacgcgtaggcaacctgcctcacacagagggatagccattggaaacgatgattaaaacctcataatgccattttatcacatgagaagatggccaaagatttatcggtgtgagatgggcctgcgtctgattagttagttggtgaggtaacggctcaccaaggcaacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggctttcgggtcgtaaacttctgtccttggggaagaaaaaaatgacggtacccatggaggaagccccggctaactacgtgccagcagccgcggtaatacgtagggggcgagcgttatccggaattattgggcgtaaagagtgcgtaggtggttacctaagcgcagggtttaaggcaatggctcaaccattgttcgccttgcgaactgggctacttgagtgcaggagaggaaagcggaattcctagtgtagcggtgaaatgcgtagatattaggaggaacaccagtggcgaaggcggctttctggactgtaactgacactgaggcacgaaagcgtggggagcaaacaggattagataccctggtagtccacgccgtaaacgatgagcactaggtgtcggggtcgcaagacttcggtgccgcagttaacgcattaagtgctccgcctggggagtacgcacgcaagtgtgaaactcaaaggaattgacggggacccgcacaagcagcggagcatgtggtttaattcgaagcaacgcgaagaaccttaccagaacttgacatccttctgacaacaccttaatcggtgtcttccttcgggacagaagagacaggtggtgcatggttgtcgtcagctcgtgtcgtgagatgttgggttaagtcccgcaacgagcgcaacccttgtcattagttgccatcattaagttgggcactctagtgagactgccggggacaactcggaggaaggtggggatgacgtcaaatcatcatgccccttatgttctgggctacacacgtgctacaatggccggtacagaaagcagcgaaaccgcgaggtggagccaatctcaaaaaccggtcccagttcggactgcaggctgaaactcgcctgcacgaagttggagttgctagtaatcgcagatcagaatgctgcggtgaatgcgttcccgggtcttgtacacaccgcccgtcacaccacggaagttgggggtgcccgaagttggtcgagaaatagattacctaaggcaaaatcaatgactggggtgaagtcgtaacaaggtaaccg

SEQ ID NO: 267 - DNA, 1413 bp, Artificial Sequence
  Synthetic Polynucleotide
agtttgattctggctcaggacgaaacgcctggcggcgtgcttaacacatgcaagtccaacgggttctgccttgtttttttgcggggtgggtcagtggcgaacgggtgagtaacacgtgagtaacctgcccctcacttctggataaccgcttgaaagggtggctaatacggggtgttctggctgtgccgcatggtgtggctgggaaagattcacttttgtggtgttttggtgggggatgggctcgcggcctatcagcttgttggtggggtgatggcctgccaaggctttgacgggtagccggcctgagagggtgggcggtcacactgggactgagatacggcccagactcctgcgggaggcagcagtggggggtattgcacaatgggcggaagcctgatgcagcgacgtcgcgtgagggatggaggccttcgggttgtgaacctctttcgccggtgaagaaggtcctgttctttgtggtggggctgacggtagccgggttatgaagcgccggctaactacgtgccagcagccgcggtaatacgtagggcgcgagcgttgtccggaattattgggcgtaaagggcttgtaggcggctggtcgcgtctgccgtgaaatcctctggctcagctgggggcgtgcggtgggtacgggctggcttgagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtggggggtctttccgggtcctccgcgccgtagctaacgctttaagtgccccgcctggggagtacggccgcaaggctaaaactcaaaggaattgacgggggcccacacaagcggcggagcatgcggattaattcgatgcaacgcgaagaaccttaccagggcttgacatgggccggctgctcctggagacgggggcctccctttttgggccggttcacaggtggtgcatggttgtcgtcagctcgtgtcgtgagatgttgggttaagtcccgcaacgagcgcaacccctgtcccgtgttgccagcgtgttgtggcggggactcgcgggagactgccggggttaactcggaggagggtggggacgacgtcaaatcatcatgccccttatgtcctgggcttcacgcatgctacaatggccggtacagtgggttgcgatgtcgtgaggcggagcgaatcccttaaagccggtctcggttcggaatcggtgttctgcgaactcgacgccgtgaaagctggagtcgctagtgaatcgcggacgagcggtgctgcggtgaaattacgtttctcgggccttgta

SEQ ID NO: 268 - DNA, 1420 bp, Artificial Sequence
  Synthetic Polynucleotide
  misc_feature (779)..(779): n is a, c, g, or t
gagtttgatcatggctcaggacgaacgctggcggcgtgcttaacacatgcaagtcgaacggtgaaggggtctgcttttgtgggtcctggatgagtggcgaacgggtgagtgacacgtgagtaacctgcccccttcttctggataaccgcatgaaagtgtggctaatacgggatattctgtgcctgctgcatggtgggtatgggaaagattgcgcctttgggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatacagcgacgccgcgtgagggatggaggccttcgggttgtaaacctctttcgccagtgaagcaggcctgccccttggtgggcgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtgnggagcgaacaggattagataccctggtagtccacgccgtaacgttgggcactaggtgtggggggccgtttccgggtttttcgcgccgtagctaacgcattaagtgccccgcctggggagtacggccggcaaggctaaaactcaaaggaatggacgggggcccgcacaagcggcggcgcctccggcttaattcgatgcaacgcgaagaaccttaccaaggcttgacgggtgcttcccccccccccccccggggtttcctccttgtggggccggaaaaaagatggtgcatggttgtcgtcggctcgtgtcgtgagatgttgggttaagtcccgcaacgagcgcaacccttgtcccgtgttgccagcacgttgtggtggggactcgcgggagactgccggggtcaactcggaggaaggtggggatgacccccccccatcatgccccttatgtcttgggcttccccccccccacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgcacacaccgcccgtc

SEQ ID NO: 269 - DNA, 1365 bp, Artificial Sequence
  Synthetic Polynucleotide
ataccgaatgtgacagtttttctcgcatgagattactgtgaaaagatggcctctatttataagctatcgctaaaggatgggctgcgtctgattagctagttggtggggtaacggcctaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcagactgtgaataatggtttgtaatgacggtagtaaacgaataagccacggctaactacgtgccagcagccgcggtaatacgtaggtggcgagcgttgtccggaattattgggcgtaaagagcatgtaggcggttttttaagtccggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgagtgaccgctctagagatagagctttcccttcggggacacgaaaacaggtggtgcatggctgtcgtcagctcgtgtcgtgagatgttgggttaagtcccgcaacgagcgcaacccctatcctatgttaccagcacgtaatggtggggactcataggagactgccaaggacaacttggaggaaggcggggatgacgtcaagtcatcatgccccttatgtcttgggctacacacgtactacaatggtcgacaacagagggaagcgaagccgcgaggcagagcaaaccccagaaactcgatctcagttcggatcgcaggctgcaacccgcctgcgtgaagtcggaatcgctagtaatcgcaggtcagcatactgcggtgaatacgttcccgggccttgtacacaccgcccgtcacaccacgaaagttggtaacacccgaagccggtggggtaacctattaggagccagccgtctaaggtggggccgatgattggggtgaagtcgtaacaaggtaaccgta

SEQ ID NO: 270 - DNA, 1400 bp, Artificial Sequence
  Synthetic Polynucleotide
attctggctcaagacgaaacgctggcggcgagcttaacacatgcaagtcgaacgggctctgtctagagctgttgtagcttgggtagggagttagtaggcgaacgggtgagtaatacgtgagtaacctgccctcttctttgggataagccttggaaacggggtctaatactggatattcctgtctggtcgcatggctgggtggggaaagttttttcggtgggggatgggctcgcggcctatcagcttgttggtggggtgatggcctaccaaggcgtcgacgggtagccggcctgagagggtgaccggccacactgggactgagatacggcccagactcctacgggaggcagcagtgggggatattgcacaatgggcgcaagcctgatgcagcgacgccgcgtgggggatgacggctttcgggttgtaaacctctttcgtcgggggacaaggctctgcttggtggtggggttgagggtacccggtgaagaagcgccggctaactacgtgccagcagccgcggtaatacgtagggcgcgagcgttgtccggaattattgggcgtaaagggctcgtaggcggcttgtcgcgtctgctgtgaaaatgcggggcttaactccgtacgtgcagtgggtacgggcaggctagagtgcggtaggggtgactggaattcctggtgtagcggtggaatgcgcagatatcaggaggaacaccgatggcgaaggcaggtcactgggctgttactgacgctgaggagcgaaagcgtggggagcgaacaggattagataccctggtagtccatgctgtaaacgttgggaactaggtgtggggttctttccacggattctgcgccggagctaacgcattaatgtcccccgcctggggagtacggcccccaagctaaaactcaaaggaattgaccggggcccggcacaggcgcggagcatggcggattaattcgatgcaacgcgaaggaacttaccaaagcttgaacatacgctggaacgttgcagagatgtgctgctttttgctggtgtacaggtggtgcattgttgttggtcagctcgtgtcgtgagatgttgggttaagtcccgcaacgagcgcaacctttgtctcgtgtggccagcaggttgggctggggactcacgggagactgccggggttaactcggaggaaggtggggatgacgtcaaatcatcatgccccttatgtcttgggcttcacgcatgctacaatggccggtacagagggttgcgatatcgtgaggtggagcgaatcccttaaagtcggtctcagttcggatcggggtctgcaactcgaccccgtgaagtcggagtcgctagtaatcgcggatcagcaacgccgcggtgaatacgttctcgggccttgcacacaccgcccgtc

SEQ ID NO: 271 - DNA, 1398 bp, Artificial Sequence
  Synthetic Polynucleotide
agtttgatcattggctcaggaacgaaacgctggcggcgtgcttaacacatgcaagtcgaacgaatgatgcggcgcttgcgccgttgattagcggcgaaacgggtgagtaacacgtgagtaacctgcccccttcttcgggataacggtctgaaagggctgctaataccgggtattcactggtctccgcatgggggctggtggaaaggttgtttttctggtgggggatgggctcgcggcctatcagcttgttggtggggtgatggcccaccaaggctttgacgggtagccggcctgagagggtgaccggtcacattgggactgagatacggcccagactcctacgggaggcagcagtggggaatattgcacaatgggcgcaagcctgatgcagcgacgccgcgtgagggatggaggccttcgggttgtgaacctctttcgcccgtggtcaagccgcgactttggttgtggtgagggtagtgggtaaagaagcgccggctaactacgtgccagcagccgcggtaatacgtagggcgcgagcgttgtccggaattattgggcgtaaagggcttgtaggcggctggtcgcgtctgccgtgaaatcctctggctcaactgggggcgtgcggtgggtacgggctggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggttcccgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccccgggcgcgcggagacgcgcgcgcatttggttgggggtgtgcaggtggtgcatggttgtcgtcagctcgtgtcgtgagatgttgggttaagtcccgcaacgagcgcaacccttgccctatgttgccagcgcgttgtggcggggactcgtgggggactgccggggttaactcggaggaaggtggggatgacgtcaaatcatcatgccccttatgtcttgggcttcacgcatgctacaatggccggtacagagggttgcgatgccgtgaggcggggcgaatcccttaaagccggtctcagttcggattggggtctgcaactcgaccccatgaaggtggagtcgctagtaatcgcagatcagcaacgctgcggtgaatacgttctcgggccttgcacacaccgcccgtc

SEQ ID NO: 272 - DNA, 1451 bp, Artificial Sequence
  Synthetic Polynucleotide
cgctagcgacaggcctaacacatgcaagtcgaggggcagcatttttgaagcttgcttcaaaagatggcgaccggcgcacgggtgagtaacgcgtatggaaccaacccgcaacagggggataacccggagaaatccggactaataccgcatagcactttctgtacataagtatagaaatttaaagatgcaaatcggttgcggacggtcatgcgttccattagctagttggcggggtaacggcccaccaaggcgacgatggataggggttctgagaggaaggtcccccacactggtactgagacacggaccagactcctacgggaggcagcagtgaggaatattggtcaatgggcgagagcctgaaccagccaagtcgcgtgagggaagactgccctatgggttgtaaacctcttttagatgagagtaaaagatcttacgagtaggattttgcaagtatcatcagaataagcatcggctaattccgtgccagcagccgcggtaatacggaagatgcgagcgttatccggatttattgggtttaaagggtgcgtaggcggataattaagtcagcggtgaaatacgtcagcttaactggcgaactgccattgaaactggttatcttgagtgtagcggaagtatgcggaatgtgtggtgtagcggtgaaatgcatagatatcacgcagaactccgattgcgaaggcagcataccatactacaactgacgctgaagcacgaaagcgtgggtatcgaacaggattagataccctggtagtccacgcagtaaacgatgaatactaaccgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggcccaaacgacaggggaatatgtgggaaaccatatagccagcaatggtcgctgtcgaggtgctgcatggttgtcgtcagctcgtgccgtgaggtgtcggcttaagtgccataacgagcgcaacccttatcgatagttactaacaggtcaagctgaggactctatcgagactgccggcgtaagccgcgaggaaggtggggatgacgtcaaatcagcacggcccttacgtccggggcgacacacgtgttacaatggcagggacagagagcagccaggcggcgacgccgcgcgaatctcgaaaccctgtctcagttcggattggagtctgcaactcgactccatgaagctggattcgctagtaatcgcgcatcagccatggcgcggtgaatacgttcccgggccttgtacacaccgcccgtcaagccatggaagccgggagcacctgaagtatgcaaccgcgaggagcgtcctagggtaaaatcggtaactggggctaag

SEQ ID NO: 273 - DNA, 1463 bp, Artificial Sequence
  Synthetic Polynucleotide
gatgaacgctggcggcatgctttacacatgcaagtcgaacggcagcatagagagcttgctctctgatggcgagtggcgaacgggtgagtaatacatcggaacgtgtccgtttgtgggggacaaccacccgaaagggtggctaataccgcataagacctgagggtgaaagccggggaccgcaaggcctggcgcgaacggagcggccgatgactgattagctggttggcggggtaaaggcccaccaaggcgacgatcagtagctggtctgagaggacgaccagccacactggaactgagacacggtccagactcctacgggaggcagcagtggggaattttggacaatgggggcaaccctgatccagccatgccgcgtgcgggaagaaggccttcgggttgtaaaccgcttttgtcagggacgaaaaggtgcgggttaagagctagcactgatgacggtacctgaagaataagcaccggctaactacgtgccagcagccgcggtaatacgtagggtgcgagcgttaatcggaattactgggcgtaaagcgtgcgcaggcggttgggtaagacagatgtgaaatccccgggcttaacctgggaactgcatttgtgactgtccgactggagtatgtcagaggggggtggaattccaagtgtagcagtgaaatgcgtagatatttggaagaacaccgatggcgaaggcagccccctggggcaaaactgacgctcatgcacgaaagcgtggggagcaaacaggattagataccctggtagtccacgccctaaacgatgtctactggttgttggagggtaaaaccttcagtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcaggaacgctccggagatggggcggtgcccgcaagggaacctgagcacaggtgctgcatggctgtcgtcagctcgtgtcgtgagatgttgggttaagtcccgcaacgagcgcaacccttgtcactagttgctacgtaacagagcactctagtgagactgccggtgacaaaccggaggaaggtggggatgatgtcaagtcctcatggcccttatggctagggcctcacacgtcatacaatggtcggaacagagggcagagaaaccgcgaggtggagcaaatcccagaaaaccgatcgtagtccggattgcagtttgcaactcgactgcatgaagtcggaatcggtagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagt

SEQ ID NO: 274 - DNA, 1509 bp, Artificial Sequence
  Synthetic Polynucleotide
tcaggacgaacgctggcggcgtgcttaacacatgcaagtcgtacgaggtgaattgaaagcttgcttttgacgaaccgagtggcaaacgggtgagtaacgcgtagacaacctgccgcaaagatggggacaacagtccgaaaggactgctaataccgaatgttgtgagattcctgcatggggatttcattaaagatggcctctacttgtaagctatcgcttcgcgatgggtctgcgtctgattagatagttggcggggtaacggccaccaagtcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactggtaaagctctgttgtcggggacgaacgtggagacggcaaacagccgtttccaatgacggtacctgacgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatggaaactatctttcttgagtgcaggagaggaaagcggaattcctagtgtagcggtgaaatgcgtagatattaggaggaacaccagtggcgaaggcggctttctggactgtaactgacgctgaggctcgaaagccaggggagcgaacgggattagataccccggtagtcctggccgtaaacgatgaatactaggtgtaggaggtatcgaccccttctgtgccggagttaacgcaataagtattccgcctggggagtacggccgcaaggctgaaactcaaaggaattgacgggggcccgcacaagcggtggagtatgtggtttaattcgacgcaacgcgaagaaccttaccagggcttgacattgagtgaaagggctagagatagctccctctcttcggagacacgaaaacaggtggtgcatggctgtcgtcagctcgtgtcgtgagatgttgggttaagtcccgcaacgagcgcaacccctatcttctgttgccagcacgtaaaggtgggaactcaggagagactgccgcggagaacgcggaggaaggcggggatgacgtcaagtcatcatgccccttatgtcctgggctacacacgtactacaatgggttggacagagagcagcgaagccgcgaggccaagcgaaccccataaaccatctcccagttcggattgcaggctgcaacccgcctgcatgaagttggaatcgctagtaatcgcaggtcagcatactgcggtgaatacgttcccgggccttgtacacaccgcccgtcacaccacggaagtcattcacacccgaagccggtgggctaaccgcaagggagcagccgtctaaggtgggggcgatgactggggtgaagtcgtaacaaggtatccgt

SEQ ID NO: 275 - DNA, 1432 bp, Artificial Sequence
  Synthetic Polynucleotide
gctttacacatgcaagtcgaacggtaacgtggggaggagcttgctccaccccgacgacgagtggcgaacgggtgagtaatacatcggaacgtgtccgcttgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacatcttcgaataaaggatgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcaatgaaatgcgtagatatgtggaagaacaccgatggcgaaggcagcctcctgggacataactgacgctcaagcaccaaagcgtggggagcaaacaggattagatacccctggagtccacgccctaaacgatgttaactagttgttgggatgtaacaatctcagtaacgcagcccagcgcgagaagttaatcccatgggaagtacggtcgcaagacttaaagatcaaaggaattgacgggggcccgcacaaccggtggatgatcttgattaattcgatgcagcgcgaaaaaccttatcttcccgtggcatgtcaggaagctcttgtaatgagagcgtgcccgcaagggagcctgaacacaggtgctgcatggctgtcgtcagctcgtgtcgtgagatgttgggttaagtcccgcaacgagcgcaccccttgtcattagttgctacgaaagggcactttagtgagactgccggtgacaaaccggaggaaggtggggaagacgtcaagtcctcatggcccttatgggtagggcttcacacgtcatacaatggtcggaacagagggcagagaagccgtgaggcggagccaatcccagaaaaccgatcgtagtccggattgcagtatgcaactcgactgcatgaagtcggaatcgttagtaatcgcggatcagcatgccgcggtgaatacgttcccgggtcttgtacacaccgcccgtcaaacaatgggagtggtgtttaccagaagtcgttagcctaaccgcaaggagggcggcgaccacggtgag

SEQ ID NO: 276 - DNA, 1429 bp, Artificial Sequence
  Synthetic Polynucleotide
  misc_feature (758)..(758): n is a, c, g, or t
cgaacgctggcggcgtgcttaacacatgcaagtcgaacgggccggccctggcatttttgttggggttggttagtggcgaacgggtgagtaacacgtgagtaacctgcccctcactccttggataacctcatgaaagtggggctaatacgggatattctggtctcctgctgcatggtggggccgggaaaggtaattgttctggtgggggatgggctcgcggcctatcagcttgttggtggggtgatggcctaccaaggcggtgacgggtagccggcctgagggggtggacggccacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggccgcctcctgtgtggggtggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggctcaactgggggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgnacaggattagataccctggtagtccacgccgtaaacgttgggcactaggtgtggggggccttttccgggtcttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtcagcgctggccgcagagatgtggtctcctccttgtggggcgctgtcacaggtggtgcatggttgtcgtcagctcgtgtcgtgagatgttgggttaagtcccgcaacgagcgcaacccttgtcctgtgttgccagcacgtggtggtggggactcgcgggagactgccggggtcaactcggaggaaggtggggatgacgtcaaatcatcatgccccttatgtcttgggcttcacgcatgctacaatggccggtacagagggctgcgatgccgtgaggcggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtgggc

SEQ ID NO: 277 - DNA, 1442 bp, Artificial Sequence
  Synthetic Polynucleotide
aacgctggcggcgtgcttaacacatgcaagtcgaactttgaagcccagcttgctgggtggatgagtggcgaacgggtgagtaacacgtgagtaacctgcccccttctttggggtaacgcccggaaacgggtgctaatactggatattcactggccttcgcatgggggttggtggaaaggttttttctggtgggggatgggctcgcggactatcagcttgttggtggggtgatggcctaccaaggctttgacgggtagccggcctgaaagggtgaccgggcacattgggactgagatacggcccacactcctacgggaggcagcagtggggaatattgcacaatgggcgaaaggctgatgcagcgacgccgcgtgagggatgacggccttgcgggttgtaaacctctttcactcatggccgagccgaaaatttaggttgtggtgagggtagtgggaaaagaagcgccggctaactacgtcccagcagccgcgggtatacgtagggcgcgagcgtgttcgggattattgggcgtaaagggcttgtagccggttggtcgcgtctgccgtgaaatcctctggcttaactggggggcgtgcggtgggtacgggctgacttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattggcgggggcccgcacaagcggcggagcatgcggattaattcgatgcaacgcgaagaaccttaccaaggcttgacatgcacggcgacactgcagagatgtggtggcatttagttggtcgtgtgcaggtggtgcatggttgtcgtcagctcgtgtcgtgagatgttgggttaagtcccgcaacgagcgcaacccttgccctatgttgccagcacgtgatggtggggactcgtgggggactgccggggttaactcggaggaaggtggggatgacgtcaaatcatcatgccccttatgtcttgggcttcacgcatgctacaatggttggtacagagggttgcgatatcgtgaggtggagcgaatcccttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagcccatgacctaaccgtttttgcggggggagtggtcgaaggtgg

SEQ ID NO: 278 - DNA, 1425 bp, Artificial Sequence
  Synthetic Polynucleotide
agtcgaacggagaattccttcgggaattcttagtggcgaacgggtgagtaacgcgtaggcaacctgccctttggatggggacaacattccgaaaggagtgctaataccgaatgtgacgattttaccgcatggtttaatcgtgaaagatggcctctacatgtaagctatcgccaaaggatgggcctgcgtctgattagctagttggtggggtaacggctcaccaaggcgacgatcagtagccggtctgagaggatgaacggccacattgggactgagacacggcccagactcctacgggaggcagcagtggggaatcttccgcaatggacgaaagtctgacggagcaatgccgcgtgagtgatgaaggttttcggaccgtaaagctcttttgtttatgacgaatgtgcatgatgtgaacaatgttgtgtaatgacggtagtaaacgaataagccacggctaactacgtgccagcagccgcggtaatacgtaggtggcaagcgttgtccggaattattgggcgtaaagagcatgtaggcggtcctttaagtctggagtgaaaatgcggggctcaaccccgtatggctttggatactgggggacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgacccctcctgtgccggagttaacgcaataagtaccccgcctggggagtacgtcggcaacgatgaaactcaaaggaattgacgggggcccgcacaagcggtggagtatgtggtttaattcgacgcaacgcgaagaaccttaccaaggcttgacattgattgaccgctctagagatagagctttcccttcggggacatgaaaacaggtggtgcatggctgtcgtcagctcgtgtcgtgagatgttgggttaagtcccgcaacgagcgcaacccctatcctatgttaccagcacgttatggtggggactcatgggagactgccaaggacaacttggaggaaggcggggatgacgtcaagtcatcatgccccttatgtcttgggctacacacgtactacaatggtcggcaacagagggaagcgaagccgcgaggcagagcaaaccccagaaacccgatctcagttcggattgcaggctgcaactcgcctgcatgaagtcggaatcgctagtaatcgcaggtcagcatactgcggtgaatacgttcccgggccttgtacacaccgcccgtcacaccacgaaagttgataacacccgaagccggtggggtaacctattaggagccagccgtctaagg

SEQ ID NO: 279 - DNA, 1498 bp, Artificial Sequence
  Synthetic Polynucleotide
agtttgatcctggctcaggacgaacgctggcggcgtgcttaacacatgcaagtcgaacgcacggccttggggttttccttggggttggtgagtggcgaacgggtgagtaacacgtgagtaacctgcccccttctttgggataacggtcggaaacggctgctaatactggatattcacacattgtcgcatggtggtgtgtggaaagcttttgtggtgggggatgggctcgcggcctatcagcttgttggtggggtgatggcttaccaaggctttgacgggtaaccggcctgagagggtgaccggtcacattgggactgagatacggcccagactcctacgggaggcagcagtggggaattttgcacaatggacgcaagtctgatgcagcgacgccgcgtgagggatggaggccttcgggttgtgaacctctttcgctcatggtcaagccgcacgtgtgcgtgtggtgagggtagtgggtaaagaagcgccggctaactacgtgccagcagccgcggtaatacgtagggcgcgagcgttgtccggaattattgggcgtaaagggcttgtaggcggttggttgcgtctgccgtgaaatcctctggcttaactgggggcgtgcggtgggtacgggctggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcacccagagcctccagagatgggggtgcatttggttgggggtgtgcaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggctggtacagagggttgcgatgctgtgaggcggagcgaatcccttaaagctggtctcagttcggatcgaagtctgcaactcgacttcgtgaaggtggagtcgctagtaatcgcagatcagcaacgctgcggtgaatacgttctcgggccttgtacacaccgcccgtcacgtcacgaaagttggtaacacccgaagctcatggcctaaccggtttgccggggggagtggtcgaaggtgggattggcgattgggacgaagtcgtaacaaggta

SEQ ID NO: 280 - DNA, 1452 bp, Artificial Sequence
  Synthetic Polynucleotide
tggctcaggatgaacgctagcgacaggcctaacacatgcaagtcgaggggcaacatggtatcagcttgctgataccgatggcgaccggcgcacgggtgagtaacgcgtatgtaatctacctgtaacagagggataacccggagaaatccggactaatacctcatagcacatattattcgcatgaattttatgttaaagagactcggttacagatgaacatgcgttccattagctagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtacgctacgtgtagtgtattgcaagtatccgaagaaaaagcatcggctaactccgtgccagcagccgcggtaatacggaggatgcaagcgttatccggatttattgggtttaaagggtgcgtaggcggcacgccaagtcagcggtgaaatttccgggctcaacccggagtgtgccgttgaaactggcgagctagagtacacaagaggcaggcggaatgcgtggtgtagcggtgaaatgcatagatatcacgcagaaccccgattgcgaaggcagcctgctagggtgaaacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtggaactcaaaggaattgacgggggcccgcacaagcggaggaacatgtggtttaattcgatgatacgcgaggaaccttacccgggctcaaacgcagggggaatatatatgaaagtatatagctagcaatagtcacctgcgaggtgctgcatggttgtcgtcagctcgtgccgtgaggtgtcggcttaagtgccataacgagcgcaacccctatcgacagttactaacgggtcaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgtacacaccgcccgtcaagccatggaagccgggagtacctgaagcatgcaaccgcaaggagcgtacgaaggtaataccggtaac

SEQ ID NO: 281 - DNA, 1446 bp, Artificial Sequence
  Synthetic Polynucleotide
gcgacaggcttaacacatgcaagtcgaggggcagcggtggagagagcttgctctcttcagccggcgaccggcgcacgggtgagtaacacgtatgcaacctgcccttgactctgggataacccggagaaatccggactaataccgggcgacaccttcggagggcatcctccttaggtcgaagggagcgattccggtcaaggatgggcatgcggcgcattagctagttggcggggtaacggcccaccaaggcgacgatgcgtaggggttctgagaggaaggtcccccacattggtactgagacacggaccaaactcctacgggaggcagcagtgaggaatattggtcaatgggcgcgagcctgaaccagccaagtcgcgtgagggaagacggccctacgggttgtaaacctcttttgtcggggagcaaggactgccacgtgtggcagggcgagagtacccgaagaaaaagcatcggctaactccgtgccagcagccgcggtaatacggaggatgcgagcgttatccggatttattgggtttaaagggtgcgtaggcggaagttcaagtcagcggtaaaatcgaggggctcaacccctttaagccgttgaaactgggtttcttgagtgggcgagaagtgtgcggaatgtgtggtgtagcggtgaaatgcatagatatcacacagaactccgattgcgaaggcagcacaccggcgcccaactgacgctgaggcacgaaagcgtggggatcaaacaggattagataccctggtagtccacgcagtaaacgatgaacactaggtgtgcggggcgaatgagctctgcgtgccacagcgaaagcgttaagtgttccacctggggagtacgccggcaacggtgaaactcaaaggaattgacgggggcccgcacaagcggaggaacatgtggtttaattcgatgatacgcgaggaaccttacccgggctcaaacggcagaggaaagtttttgaaaggaggctgctctacggagcctctgccgaggtgctgcatggttgtcgtcagctcgtgccgtgaggtgtcggcttaagtgccataacgagcgcaacccctaccgccagttgccatcaggtaaagctggggactctggcgggactgccggcgcaagctgtgaggaaggcggggatgacgtcaaatcagcacggcccttacgtccggggcgacacacgtgttacaatggcaggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgtcctagggtaaaactggtgactgg

SEQ ID NO: 282 - DNA, 1447 bp, Artificial Sequence
  Synthetic Polynucleotide
gcggcatgctttacatatgcaagtcgaacggcagcatggagagcttgctctctgatggcgagtggcgaacgggtgagtaatacatcggaacgtgtcctgttgtgggggataactactcgaaagagtagctaataccgcataagacctaagggtgaaagcgggggaccttcgggcctcgcgcagttggagcggccgatgactgattagctagttggtggggtaaaggcctgccaaggcgacgatcagtagctggtctgagaggacgaccagccacattgggactgagacacggcccaaactcctacgggaggcagcagtggggaattttggacaatgggggcaaccctgatccagccatgccgcgtgcgggaagaaggccttcgggttgtaaaccgcttttgttaggaacgaaaaggtatctgtgaacaacaggtattgctgacggtacctaaagaataagcaccggctaactacgtgccagcagccgcggtaatacgtagggtgcgagcgttaatcggaattactgggcgtaaagcgtgcgcaggcggttgggtaagacaggtgtgaaatccccgagcttaacttgggaactgcacttgtgactgctcaactagagtatgtcagagggaggtggaattccaagtgtagcagtgaaatgcgtagatatttggaagaacaccgatggcgaaggcagcctcctgggataatactgacgctcatgcacgaaagcgtggggagcaaacaggattagataccctggtagtccacgccctaaacgatgtcaactagttgttgggccgcatggcttagtaacacagctaacgcgagaagttgaccgcctggggagtacggtcgcaagattaaaactcaaaggaattgacggggacccgcacaagcggtggatgatgtggattaattcgatgcaacgcgaaaaaccttacctagccttgacatgccaggaatcctgatgaaagttgggagtgcccgcaagggaatctggacacaggtgctgcatggctgtcgtcagctcgtgtcgtgagatgttgggttaagtcccgcaacgagcgcaacccttgtcactagttgctacgcaagagcactctagtgaaactgccggtgacaaaccggaggaaggtggggatgacgtcaagtcctcatggcccttatggctagggcctcacacgtcatacaatggtcggaacagagggcagcgaagctgtgaagtggagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccacgaaagtcattcacacccgaagccggtgaggcaaccgcaaggaaccagccgtcgaaggtgggggcgatgattggggtgaag

SEQ ID NO: 283 - DNA, 1520 bp, Artificial Sequence
  Synthetic Polynucleotide
ttgagagtttgatcctggctcaggacgaacgctggcggcatgcctaacacatgcaagtcgaacggagactatttcggtagtcttagtggcgaacgggtgagtaacgcgtgggcaacctgccctctagatggggacaacatcccgaaaggggtgctaataccgaatgtgacgatttatccgcatggatttatcgtgaaagatggcctctacatgtaagctatcgctagaggatgggcctgcgtctgattagctagttggtggggtaacggcctaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaaactcttttgtttatgacgaatgtgcagattgtgaataattatttgtaatgacggtagtaaacgaataagccacggctaactacgtgccagcagccgcggtaatacgtaggtggcgagcgttgtccggaattattgggcgtaaagagcatgtaggcggtttcttaagtctggagtgaaaatgcggggctcaaccccgtatggctctggatactgggagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgacccctcctgtgccggagttaacgcaataagtaccccgcctggggagtacgtccgcaaggatgaaactcaaaggaattgacgggggcccgcacaagcggtggagtatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttgggggctcatgcgagactgcctgcgatgagcaggaggaaggtggggatgacgtcaagtcatcatgccccttatacgctgggctacacacgtgctacaatggcgtaaacaaagggaagcaggagtgcgagcttgagcaaatcccaaaaataacgtcccagttcggactgcagtctgcaactcgactgcacgaagctggaatcgctagtaatcgcagatcagaatgctgcggtgaatacgttcccgggtcttgtacacaccgcccgtcacaccatgggagtcagtaacgcccgaagtcagtgacctaaccgcaagggaggagctgccgaaggcgggaccgataactggggtgaagtcgtaacaaggtagccgta

SEQ ID NO: 284 - DNA, 1442 bp, Artificial Sequence
  Synthetic Polynucleotide
gcgacaggcctaacacatgcaagtcgaggggcagcggagaggtagcaatacctttgccggcgaccggcgcacgggtgagtaacacgtatgcaatccacctgtaacagggggataacccggagaaatccggactaataccccataatatgggcgctccgcatggagagtccattaaagagagcaatcttggttacagacgagcatgcgctccattagccagttggcggggtaacggcccaccaaggcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtacgctacgcgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaatttccgggcccaacccggagtgtgccgttgaaactggcgagctagagtacacaagaggcaggcggaatgcgtggtgtagcggtgaaatgcatagatatcacgcagaaccccgattgcgaaggcagcctgctagggtgaaacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatatatatgaaagtatatagctagcaatagtcacctgcgaggtgctgcatggttgtcgtcagctcgtgccgtgaggtgtcggcttaagtgccataacgagcgcaacccctatggacagttactaacgggtgaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgtacacaccgcccgtcaagccatgggagccgggggtacctgaagtgcgtaaccgcgaggagcgccctagggtaaaactggtgactggggc

SEQ ID NO: 285 - DNA, 1383 bp, Artificial Sequence
  Synthetic Polynucleotide
gacgaacgctggcggcgtgcttaacacatgcaagtcgaacgagacgattgaaagcttgcttttgaaagtcgagtggcaaacgggtgagtaacgcgtagacaacctgccgcaaagatggggacaacagtccgaaaggactgctaataccgaatgttgcgaaagctccgcatggagcattcgttaaagatggcctctacttgtaagctatcgctttgtgatgggtctgcgtctgattagatagttggtggggtaacggcctaccaagtcgacgatcagtagccggtctgagaggatgaacggccacattggaactgagacacggtccagactcctacgggaggcagcagtggggaatcttccgcaatgggcgaaagcctgacggagcaacgccgcgtgagtgaagaagggtttcggctcgtaaagctctgttgtcggggacgaacgtgagacgtgtgaagaatgcgttttaatgacggtacctgacgaggaagccacggctaactacgtgccagcagccgcggtaatacgtaggtggcgagcgttgtccggaattattgggcgtaaagggagcgcaggcgggatatcaagtctttcttaaaagtgcggggctcaaccccgtgatgggaaggaaactggtattcttgagtgcaggagaggaaagcggaattcctagtgtagcggtgaaatgcgtagatattaggaggaacaccagtggcgaaggcggctttctggactgtaactgacgctgaggctcgaaagccaggggagcgaacgggattagataccccggtagtcctggccgtaaacgatgaatgctaggtgtgggaggtatcgacccctcctgtgccggagttaacgcaataagcattccgcttggggagtacggtcgcaagactgaaactcaaaggaattgacgggggcccgcacaagcggtggagtatgtggtttaattcgacgcaacgcgaagaaccttaccagggcttgacattgagtgaaagggcaagagattgctccctctcttcggagacacgaaaacaggtggtgcatggctgtcgtcagctcgtgtcgtgagatgttgggttaagtcccgcaacgagcgcaacccctatcatttgttgccagcacgtcaaggtgggaactcaaatgagactgccgcggagaacgcggaggaaggcggggatgacgtcaagtcatcatgccccttatgtcctgggctacacacgtactacaatgggatggacagagagcagcgaaagggtgatctcaagcgaacctcataaaccatctcccagttcggattgcaggctgcaacccgcctgcatgaagtcggaatcgctagtaatcgctggtcagcatacagcggtgaaatacgttcccgggcct

SEQ ID NO: 286 - DNA, 1449 bp, Artificial Sequence
  Synthetic Polynucleotide
catgctttacacatgcaagtcgaacggcagcacagggagcttgctcccgggtggcgagtggcgcacgggtgagtaatacatcggaacgtgtcctgttgtgggggataactgctcgaaagggtggctaataccgcatgagacctgagggtgaaagcgggggatcgcaagacctcgcgcaattggagcggccgatgcccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggccttcgggttgtaaactgcttttgtcagggacgaaaaggaccgtgttaataccatggtctgctgacggtacctgaagaataagcaccggctaactacgtgccagcagccgcggtaatacgtagggtgcaagcgttaatcggaattactgggcgtaaagcgtgcgcaggcggttctgtaagacagatgtgaaatccccgggcttaacctgggaattgcatttgtgactgcaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacaggattagataccctggtagtccacgccctaaacgatgtctactggttgttggggttttttaaccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaatcctgaagagattcgggagtgcccgcaagggaatctggacacaggtgctgcatggctgtcgtcagctcgtgtcgtgagatgttgggttaagtcccgcaacgagcgcaacccttgtcactagttgctacgtaagagcactctagtgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtctgcaatgcccaaagccggtggcctaaccttcgggaaggagccgtctaaggcagggcagatgactggggtgaagtcgt

SEQ ID NO: 287 - DNA, 1449 bp, Artificial Sequence
  Synthetic Polynucleotide
cgctagcgacaggcctaacacatgcaagtcgaggggcagcggataggtagcaatacctttgccggcgaccggcgcacgggtgagtaacacatatgcaatccacctgtaacagggggataacccggagaaatccggactaataccccataatatgggctctccgcatggagggtccattagagagagcaattttggttacagacgagcatgcgctccattagccagttggcggggtaacggcccaccaaagcgacgatggataggggttctgagaggaaggtcccccacattggaactgaaacacggtccaaactcctacgggaggcggcagtgaggaatattggtcaatggtcggcagactgaaccagccaagtcgcgtgagggaagccggccctacgggttgtaaacctcttttgtcggagagtaaagtacgctacgtgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtggaattttcgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagataccctggtagtccacgcagtaaacgatgaatactaactgtttgcgatacaatgtaagcggtacagtgaaagcgttaagtattgcacatggtgagtacactgacaacgatgaaaatcaaaggaattgacggcgacccgcacaacaggaggaacatgtggtttaattcgatgatacgcgaggaacccttacccgtgctcaaacgcagggggaatatatatgaaagtttatagactagcaatagtcacttgcgcaggtgctgtcatgatggtcgtcagctgagtaccgtgaggagttggcttatgtgaccataacgagtgcaacccctatcgacagttactaacgggtcaagccgaggactctgtcgagagcgccggggcagaccgcgaggaaggtggggatgtcgtcaaatcagcacggccattacgtccggggcgacacacgtgttacaatggcaggtacagaaggcagccagtcagcaatgactcgagaatcccgaaaacctgtctcagttggtattggagtctgcaaccagactccatgaagctggattatctagtaatcgcgcatcagccatggcgcggtgaatacgtttccgggccttgtacactccgcccgtcaagccatggaagccgggagtacgtgaagcatgcaaacgcaaggagcgtacgaaggtaataccggtaactg

SEQ ID NO: 288 - DNA, 1405 bp, Artificial Sequence
  Synthetic Polynucleotide
tcatggctcaggacgaacgctggcggcgtgcctaatacatgcaagtcgaacgagagcgaccggtgcttgcactggttaatctagtggcgaacgggtgagtaacacgtgggtaacctgcccattagagggggataacatccggaaacggatgctaaaaccgcataggtcttcgagccgcatggcttgaagaggaaaagaggcgcaagcttctgctgatggatggacccgcggtgcattagcttgttggtggggtgatggcctgccaaggctttgacgggtagccggcctgagagggtgggcggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagaaggtcctgctctttgtggtgggattgacggtagctgggttaatgaagcgccggctaactacgtgccagcagccgcggtaatacgtagggcgcgagcgttgtccggaattattgggcgtaaagggcttgtaggcggctggtcgcgtctgccatgaaatcctctggctcagctgggggcgtgcggtgggtacgggctggcttgagtgcggtaggggagactggaactcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggctggattgcttcggagacggggtttcccttttttgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggttaactcggaggaaggtggggatgacgtcaaatcatcatgccccttatgtcttgggcttcacgcatgctacaatggccggtacagtgggttgcgatgctgtgaggcggagcgaatccctgaaagccggtctcagttcggatcggtgtctgcaactcgacaccgtgaagttggagtcgctagtaatcgcagatcagcagcgctgcggtgaatacgttctcgggccttgtacacaccgcccgtca

SEQ ID NO: 289 - DNA, 1415 bp, Artificial Sequence
  Synthetic Polynucleotide
cgctggcggcgtgcctaacacatgcaagtcgaacggagataaagatttcggtttttatcttagtggcgcacgggtgagtaacacgtgaataacctgacccaaagagggggataacacctggaaacaggtgctaataccgcataagaccacaatgtcgcatgacgaaggggtcaaagaaaatcgctttgggaggggttcgcgtcccattaggtagtaggcggggtaacggcccacctagccaacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcagaagacgaaggaagtgacggtattctgtgaggaagccccggctaactacgtgccagcagccgcggtaatacgtagggggcgagcgttgtccggaattactgggcgtaaagggagcgtaggcggtctgataagttggatgtgaaatacccgggcttaacttggggggtgcatccaatactgttggactagagtacaggagaggaaagcggaattcctagtgtagcggtgaaatgcgtagatattaggaggaacaccagtggcgaaggcggctttctggactgttactgacactgaggcacgaaagtgtggggagcaaacaggattagataccctggtagtccacaccgtaaacgatgagcactaggtgtcggggtcgcaagacttcggtgccgcagttaacgcattaagtgctccgcctggggagtacgtacgcaagtatgaaactcaaaggaattgacggggacccgcacaagcagcggagcatgtggtttaattcgaagcaacgcgaagaaccttaccaggacttgacatccctctgaaacccctgataacgaaggggcctctacggacagaggagacaggtggtgcatggttgtcgtcagctcgtgtcgtgagatgttgggttaagtcccgcaacgagcgcaacccttgctgttagttgccatcattgagttgggcactctaacgggactgccggggataactcggaggaaggtggggatgacgtcaaatcatcatgccccttatgttctgggctacacacgtgctacaatggtcggtacaaagagcagcaagaccgcgaggtggagcaaatctcaaaaaccgatcccagttcggattgcaggctgcaactcgcctgcatgaagttggagttgctagtaatcgcgaatcagaatgtcgcggtgaatgcgttcccgggtcttgtacacaccgcccgtcacaccacggaagttgggggtgcccaaagttggtcaaaaaatagattacctaaggcaaaaccaatgactgg

SEQ ID NO: 290 - DNA, 1404 bp, Artificial Sequence
  Synthetic Polynucleotide
gagtttgatcatggctcaggacgaacgctggcggcgtgcttaacacatgcaagtcgaacgggcctgctccttgtgggtgggttagtggcgaacgggtgagtatcacgtgagtaacctgccccctgctcctggataacgctctgaaaggggtgctaatacggggtgtgctggtgctgccgcatggtggtgccgggataggttccctctttggggggttctggtgggggatgggctcgcggcctatcagcttgttggtggggtgatggcctaccaaggcggtgacgggtagccggcctgagagggtggacggccacactgggactgagacacggcccagactcctgcgggaggcagcagtggggggtattgcgcaatgggcggaagcctgacgcagcgacgccgcgtgagggacggaggccttcgggttgtgaacctctttcgccggtggagaaggcgcccccgtgtggggtgctgactgtagccggataagaagcgccggctaactacgtgccagcagccgcggtaatacgtagggcgcgagcgttgtccggagttactgggcgtaaagggcttgtaggcggctggtcgcgtctgccgtgaaatcccctggctcaactgggggcgtgcggtgggtacgggccggcttgagtgcggtaggggaggctggaactcctggtgtagcggtggaatgcgcagatatcaagaagaacaccggtggcgaaggcgggtctctgggccgttactgacgctgaggagcgagagcgtgtggagcgaacaggattagatactctggtactccacgccgtaaacgttgggcactacgtgtggggggcctctatcggctcgtccgcgccgtagataacgcattaagtgccccgcctggggagtacggccgcaaggctaaaactcaaaggaattgatgggggcccgctcaagcggcggagcatgcggattaattcgattcgtcgcgaagaaccttaccagggcttgacatgggcctgttgtctgcggagacgtgggctcccccttgtggggccggtttgcaggtggtgcatggttgtcgtcagcttgtgtcttgagatgttgggttaagtcccgcaacgagcgcaacccctgtcctgtgttgccagcacgtcgtggtggggactcgcgggagactgccggggtcaactcggaggagggtggggacgacgtcaaatcatcatgccccttatgtcctgggcttcacgcatgctacaatggccggtacagagggttgcgatgccgtgaggcggggcgaatcccttaaagccggtctcagttcggatcggtgtttgcaactcgacaccgtgaagctggagtcgctagtaatcgcggatcagcaacgccgcggtgaatacgttctcgggctttgtacacaccgcc

SEQ ID NO: 291 - DNA, 1454 bp, Artificial Sequence
  Synthetic Polynucleotide
aacgctggcggcgtgcctaacacatgcaagtcgaacggggatcatgaagcggaagttttcggatggaaggttcatgattctagtggcgcacgggtgagtaacgcgtgaacaacctgcctttcagtgggggataacacctggaaacaagtgctaataccgcatgagaccacgacctggcatcgggatggggtcaaagatttatcgctgaaagaggggttcgcgtcccattaggtagttggtgagataacagcccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggtcttcggattgtaaacctctgtcgcaagggacgaaggcgtgacggtaccttgtgaggaagccccggctaactacgtgccagcagccgcggtaatacgtagggggcgagcgttgtccggaattactgggcgtaaagggtgcgtaggcggttgcttaagttggatgtgaaatacccgggcttaacttggggggtgcattcaaaactgggcgactagagttcaggagagggaagcggaattcctagtgtagcggtgaaatgcgtagatattaggaggaataccagtggcgaaggcggctttctggactgacactgacgctgaggcacgaaagcgtggggagcaaacaggattagataccctggtagtccacgctgtaaacgatgaatactaggtgtagggggtatgaactccctctgtgccgtagcaaacgcaataagtattccgcctggggagtacggccgcaaggttgaaactcaaaggaattgacgggggcccgcacaagcagcggagcatgtggtttaattcgaagcaacgcgaagaaccttaccaaggcttgacatcctgctaaagtcatggaaacatgatgtcccttcgggggagcagagacaggtggtgcatggttgtcgtcagctcgtgtcgtgagatgttgggttaagtcccgcaacgagcgcaacccctgttgccagttaccagcgcgtagaggcggggactctggtgagactgccggggacaactcggaggaaggtggggacgacgtcaaatcatcatgccccttatgtcttgggctacacacgtgctacaatggctgtaacaaagggaagcgagtgcgtaagcatgagcggatctcagaaaagcagtctcagttcggattgtgggctgcaacccgcccacatgaagttggagttgctagtaatcgcggatcagcatgccgcggtgaatacgttcccgggccttgtacacaccgcccgtcacaccatgggagttgggagcgcccgaagccggtatcctaaccgaaaggagggagccgtcgaaggtgagaccaatgactggggtga

SEQ ID NO: 292 - DNA, 1489 bp, Artificial Sequence
  Synthetic Polynucleotide
attgaacgctggcggcatgctttacacatgcaagtcgaacggcagcacagggagcttgctcccgggtggcgagtggcgcacgggtgagtaagacatcggaacgtgtcctcttgtgggggataactacccgaaagggtggctaataccgcataagtcctgagggagaaagcgggggatcttcggacctcgcgcgagaggagcggccgatggccgattagctagttggtgaggtaaaggctcaccaaggcgacgatcggtagctggtctgagaggacgaccagccacactgggactgagacacggcccagactcctacgggaggcagcagtggggaattttggacaatgggcgaaagcctgatccagccatgccgcgtgtgggatgaaggccttcgggttgtaaaccacttttgtcagggacgaaaaggttcaggcyaataccttgaactgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggcttaaccttggaattgcatttatgactgcaggactcgagtttgtcagaggggggtggaattccaagtgtagcagtgaaatgcgtagatatttggaagaacaccgatggcgaaggcagccccctgggacatgactgacgctcatgcacgaaagcgtggggagcaaacaggattagataccctggtagtccacgccctaaacgatgtctactggttgttggggacgatttggtccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcggaaagctctgagagatcggagygtgcccgcaagggaatccgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgtctaaccgcaaggaggacggcgtccacggtgggtttcatgactggggtgaagtcgtaacaaggtagccgtaccggaagg

SEQ ID NO: 293 - DNA, 1463 bp, Artificial Sequence
  Synthetic Polynucleotide
gatgaacgctggcggcgtgcttaacacatgcaagtcgaacgaagcatttaagacggattctttcgggatgaagacttttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcatagatattaggaggaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgactgggaagtaatgttccctttccttcgggacagaggagacaggtggtgcatggttgtcgtcagctcgtgtcgtgagatgttgggttaagtcccgcaacgagcgcaacccttatcctaagtagccagcaggtaaagctgggcactcttgggagactgccagggataacctggaggaaggtggggatgacgtcaaatcatcatgccccttatgacttgggctacacacgtgctacaatggcgtaaacaaagggaagcgaaagtgtgagctggagcaaatctcagaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcgataacgcccgaagccagtgacctaaccgaaagggaggagctgtcgaaggcgggattgataactggggtgaagtcgt

SEQ ID NO: 294 - DNA, 1442 bp, Artificial Sequence
  Synthetic Polynucleotide
gctttacacatgcaagtcgaacggtaacgtggggaggagcttgctccaccccgacgacgagtggcgaacgggtgagtaatacatcggaacgtgtccgctcgtgggggacaaccatccgaaaggttggctaataccgcatgagttctactgaagaaagagggggacccgcaagggcctctcgcgagcggagcgaccgatgactgattagcctgttggtgaggtaacggctcaccaaagcaacgatcagtagctggtctgagaggacgaccagccacactgggactgacacacggcccacactcctacgggaggcagcagtggggaattttggacagtgggcgcaagcctgatccagctattccgcgtgtgggatgagcgccctcgggttgtaaaccacttttgtagagaacgaaaagacatcttcgaataataggatgttgctgacggtactctaagaataagcaccggctaactacgtgccagcagccgcggtaatacgtagggtgcgagcgttaatcgtaattactgggcgtaaagggtgcgcaggcggttgagtaatgacagatgtgaaatcctcaagcttaactctggaatggaatatgtgactgctcgactagagtgagtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccctaaacgatgttaactagttgttgggatgtaacaatctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccttgacatgtcaggaagctcttgtaatgagagcgtgcccgcaagggagcctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagcgaagccgtgaggcggagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcagacaatgggagtggtgtttaccagaagtcgttagcctaaccgcaaggagggcggcgaccacggtgagcaccgtgact

SEQ ID NO: 295 - DNA, 1431 bp, Artificial Sequence
  Synthetic Polynucleotide
caggacgaacgctggcggcgtgcttaacacatgcaagtcgaacggggatattcgcttcggcggatattctagtggcggacgggtgagtaacgcgtgaacaagctgtcctatacagggggataacactgagaaatcagtgctaataccgcataagaccacaacctcgcatggggaaggggtcaaaggaggaatccggtagaggaggcgttcgcgtcccattagatagttggcggggtaacggcccaccaagtcagcgatgggtagccgagctgagaggctgatcggccacactgggactgagacacggcccagactcctacgggaggcagcagtggggtatattgggcgatgggggaaacccttacccagcaacgccgcgtgagagaagaaggttttcggattgtaaatctctgtccttgagggcgaaggaagtgacggtactcgaggaggaagccccggctaactacgtgccagcagccgcggtaatacgtagggggcgagcgttgtccggaattattgggcgtaaagggcgtgtagacggttttataagttacgggtgaaagcccatttttcaaggatggaactgcctgtaagactgtaggacttgagtgcaggagagggaagcggaattccaagtgtagcggtgaaatgcgtagatatttggaggaacaccagtggcgaaggcggctttctggactgcaactgacgttgaggcgcgaaagcgtggggagcgaacaggattagataccctggtagtccccgctgtaaacgatgggatgctaggtgtgggaggtatcgaccccttccgtgccggagttaacgcaataagcatcccgcctggggagtacggccgcaaggttgaaactcaaaggaattgacgggggcccgcacaagcagcggagcatgtggtttaattcgacgcaacgcgaagaaccttaccaggacttgacatctatctaaggctattgaaaggtagcgtcccttcgggggagataagacaggtggtgcatggttgtcgtcagctcgtgtcgtgagatgttgggttaagtcccgcaacgagcgcaacccttatgatcagttactaacgcgtagaggcgaggactctgatgagactgccggggacaactcgggggaaggtggggacgatgtcaaatcatcatgccccttatgttctgggctacacacgtgctacaatggcagtcaacaaagaggagcgagtccgcaaggaggagcaaatctcaaaaaagctgtcccagttcggattgtgggctgcaacccgcccacatgaagtcggagttgctagtaatcgcggatcagcatgccgcggtgaatacgttcccgggccttgtacacaccgcccgtcacaccatgggagtttggagcacccgaagtcagtgaggtaacccggaagggagccagctgccgaaggtg

SEQ ID NO: 296 - DNA, 1474 bp, Artificial Sequence
  Synthetic Polynucleotide
aggacgaacgctggcggcatgcctaacacatgcaagtcgaacggggattgcttcggtaatcctagtggcgaacgggtgagtaacgcgtaggcaacctgccctttagatggggacaacatcccgaaaggggtgctaataccgaatacgaccggacttccgcatgggagcccggtgaaagatggcctctacaagtaagctatcgctaaaggatgggcctgcgtctgattagctagttggtggggtaatggcccaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgaagaaggaattcgttccgtaaagctctgttgtctatgacgaatgtgcatactgtgaacaatggtgtgtaatgacggtagtagacgaggaagccacggctaactacgtgccagcagccgcggtaatacgtaggtggcgagcgttgtccggaattattgggcgtaaagagcatgtaggcggtctgttaagtctggagtgaaaatgaggggctcaaccccgtatggctctggatactggtagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgagaagaaccttaccaaggcttgacattgaatgaccatcttagagataagattttcccttcggggacatgaaaacaggtggtgcatggctgtcgtcagctcgtgtcgtgagatgttgggttaagtcccgcaacgagcgcaacccctatcctatgttaccagcgagtgaagtcggggactcataggagactgccagggacaacctggaggaaggcggggatgacgtcaagtcatcatgccccttatgtcttgggctacacacgtactacaatggtcgacaacagagggaagcgaagccgcgaggcagagcgaaccccagaaactcgatctcagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtggggtaaccgtaaggagccagccgtctaaggtggggccgatgattgggg

SEQ ID NO: 297 - DNA, 1441 bp, Artificial Sequence
  Synthetic Polynucleotide
tgaacgctagcgacaggcctaacacatgcaagtcgaggggcaacatggtatcagcttgctgatactgatggcgaccggcgcacgggtgagtaacgcgtatgtaatctacctgtaacagagggataacccggagaaatccggactaatacctcatagcacatattattcgcatgaattttatgttaaagagactcggttacagatgaacatgcgttccattagctagttggcggggttacggcccaccaaggcaacgatggataggggttctgagaggaaggtcccccacactggtactgagacacggaccagactcctacgggaggcagcagtgaggaatattggtcaatgggcgaaagcctgaaccagccaagtcgcgtggaggaagacggccctacgggttgtaaactccttttacctgggaataacgggcgctacgtgtagcgctgtgcaagtaccgggagaataagcatcggctaattccgtgccagcagccgcggtaatacggaagatgcgagcgttatccggatttattgggtttaaagggtgcgtaggcggaagaataagtcagcggtgaaatgcttcagctcaactggggaattgccgatgaaactgtttttctagagtataaaagaggtatgcggaatgcgtggtgtagcggtgaaatgcatagatatcacgcagagccccgattgcgaaggcagcatactgggctataactgacgctgaagcacgaaagcgtgggtatcgaacaggattagataccctggtagtccacgccgtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacaggggaataatcccgaaaaggattagccagcaatcgccgctgtggaggtgctgcatggttgtcgtcagctcgtgccgtgaggtgtcggcttaagtgccataacgagcgcaacccttaccaatagttgccatcaggtaacgctggggactctatcgggactgccgtcgtaagatgtgaggaaggtggggatgacgtcaaatcagcacggcccttacgtccggggctacacacgtgttacaatggggggtacagcaggccgctaccgggcgaccggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtatgcaaccgcaaggagcgccctagggtaaaactggtga

SEQ ID NO: 298 - DNA, 1455 bp, Artificial Sequence
  Synthetic Polynucleotide
gaacgctggcggaacgctttacacatgcaagtcgaacggtaacgcggagagaagcttgcttctctccggcgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcgaccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacaccttcgaataaagggtgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccttaaacgatgttaattagttgttgggaagtaaaattgtctgtaacgcagccaacgcgagaagttaaccgcctgggaagtacggtcgcaagactaaaactcaaaggaattgacggggacccgcacaagcggtggatgatgtggattaattagatgcaacgcgaaaaaccttacctacccttgacatgtcaggaagcttttgtaatgagagtgtgcccgcaagggagcctgaacacaggtgctgcatggctgtagtcagctcgtgtcgtgagatgttgggttaagtcccgcaacgagcgcaacctttgtcattagttggtatgaaagggcactgtagtgagactgccggtgacaaaccggaggaaggtggggatgacgtcaagtcctcatggcccttatgggtagggcttcacacgtcatacaatggtcggaacagagggcagcgaagtcgtgagacggagccaatcccagaaaaccgatcgtagtccggattgcagtctgcaactcgactgcatgaagtcggaatcggtagtaatcgcggatcagcatgccgcggtgaatacgttcccgggtcttgtacacaccgcccgtcaaacaatgggagtggtgtttaccagaagtcgttagcctaaccgcaaggagggcggcgacctcggtgagcaccgtgact

SEQ ID NO: 299 - DNA, 1424 bp, Artificial Sequence
  Synthetic Polynucleotide
aacgctggcggcgtgcctaacacatgcaagtcgagcgagaagctgatgattgattcttcggatgaaagattcagtggaaagcggcggacgggtgagtaacgcgtaggcaacctgccttatgcagagggatagccattggaaacgatgattaaaacctcataacgcagaagattcacatggttcttctgccaaagatttatcggcataagatgggcctgcgtctgattagctggttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggaagaaggccttcgggtcgtaaacttctgtccttggggaagaagaactgacggtacccaaggaggaagccccggccaactacgtgccagcagccgcggtaatacgtagggggcaagcgttatccggaattattgggcgtaaagagtacgtaggtggcaacttaagcgcagggtttaaggcaatggctcaaccattgttcgccctgcgaactgggatgcttgagtgcaggagaggaaagcggaattcctagtgtagcggtgaaatgcgtagatattaggaggaacaccagtggggaaggcggctttctggactgtaactgacactgaggtacgaaagcgtggggagcaaacaggattagataccctggtagtccacgccgtaaacgatgagcactaggtgtcggggtcgcaagacttcggtgccggagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatccctctgacgtatccttaatcggatatttcttcggacagaggagacaggtggtgcatggttgtcgtcagctcgtgtcgtgagatgttgggttaagtcccgcaacgagcgcaacccttgccattagttgccagtagtaagatgggcactctaatgggactgccggggacaactcggaggaaggtggggatgacgtcaaatcatcatgccccttatgttctgggctacacacgtgctacaatggccggtacagaaagcagcgaagtcgtgaggcggagcaaatctcgaaaaccggtcccagttcggactgcaggctgcaactcgcctgcacgaagccggagttgctagtaatcgcggatcagaatgccgcggtgaatgcgttcccgggtcttgtacacaccgcccgtcacaccatggaagttgggggtgccagaagccggcagggtaatatgctgtctaaggcaaaaccaat

SEQ ID NO: 300 - DNA, 1357 bp, Artificial Sequence
  Synthetic Polynucleotide
gatgaacgctggcggcgtgcctaacacatgcaagtcgagcgagaaacctttcaacgaaagctttcggtagattttgagaggtggaaagcggcggaacgggtgagtaacgcgtaggcaacctgccccttgcagagggatagcctcgggaaaccgggattaaaacctcataatgcctttgaagcacatgctataaaggtcaaagatttatcggcaagggatgggcctgcgtctgattagctagtaggtggggtaacggcctacctaggcgacgatcagtagccgacctgagagggtgatcggccacattggaaccgagacacggtccaaactcctacgggaggcagcagtggggaatattgcacaatgggcgaaagcctgatgcagcaacgccgcgtgaaggaagaaggcctttgggtcgtaaacttctgtccttggggaagaataatgacggtacccttggaggaagccccggctaactacgtgccagcagccgcggtaatacgtagggggcaagcgttatccggaattattgggcgtaaagagtacgtaggtggttttcctaagcacagggtttaaggctaaggctcaaccatagttcgccctgtgaactgggagacttgagtgcaggagaggaaagcggaattcctagtgtagcggtgaaatgcgtagatattaggagaaacaccagtggcgaaggcggctttctggactgtaactgacactgaggtacgaaagcgtggggagcaaacaggattagataccctggtagtccacgccgtaaacgatgagcactaggtgtcggggccgcaaggtttcggtgccgcagttaacgcattaagtgctccgcctggggagtacgcacgcaagtgtgaaactcaaaggaattgacggggacccgcacaagcagcggagcatgtggtttaattcgaagcaacgcgaagaaccttaccagggcctgacatccctctgaccggactttaacaggtctttctcttcggagcagaggtgacaggtggtgcatggttgtcgtcagctcgtgtcgtgagatgttgggttaagtcccgcaacgagcgcaacccttgtcattagttgccatcattaagttgggcactctagtgagactgccggggacaactcggaggaaggtggggatgacgtcaaatcatcatgccccttatgttctgggctacacacgtgctacaatggccggtacagaaagcagcgaagtcgtgaggcggagcaaatctccgaaaaccggtcccggttcggattgcaggctgcaactcgcctgcatgaagttggagttgctagtaatcgcagaatcagaaatgctgcggtgaaatgcgttcccgggtct

SEQ ID NO: 301 - DNA, 1436 bp, Artificial Sequence
  Synthetic Polynucleotide
tggcggcgtgcttaacacatgcaagtcgaacgaagcatttgcgacagatttcttcggattgaagttgcttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagggggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagggtatgtaatgtactttctcttcggagcatcggtgacaggtggtgcatggttgtcgtcagctcgtgtcgtgagatgttgggttaagtcccgcaacgagcgcaacccctgttcttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcga

SEQ ID NO: 302 - DNA, 1449 bp, Artificial Sequence
  Synthetic Polynucleotide
  misc_feature (724)..(724): n is a, c, g, or t
gcgtgcttaacacatgcaagtcgaacgaagcatttaagatggattctttcgggatgaagacttttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtgnggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtataattcgaagcaacgcgaagaaccttaccaagtcttgacatcctcttgaccggtcagtaatgtggccttttcttcggaacaagagtgacaggtggtgcatggttgtcgtcagctcgtgtcgtgagatgttgggttaagtcccgcaacgagcgcaacccctattcttagtagccagcatataaggtgggcactctagggagactgccagggataacctggaggaaggtggggatgacgtcaaatcatcatgccccttatgaccagggctacacacgtgctacaatggcgtaaacaaagggaagcaaagctgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgt

SEQ ID NO: 303 - DNA, 1452 bp, Artificial Sequence
  Synthetic Polynucleotide
tgaacgctagcgacaggcctaacacatgcaagtcgaggggcagcggagaggtagcaatacctttgccggcgaccggcgcacgggtgagtaacacgtatgcaatccacctgtaacagggggataacccggagaaatccggactaataccccataatatgggctctccgcatggagggtccattaaagagagcaattttggttacagacgagcatgcgctccattagccagttggcggggtaacggcccaccaaagcgacgatggataggggttctgagaggaaggtcccccacattggaactgagacacggtccaaactcctacgggaggcagcagtgaggaatattggtcaatggtcgacagactgaaccagccaagtcgcgtgagggaagacggccctacgggttgtaaacctcttttgtcggagagtaaagtacgctacgtgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaattttcgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagataccctggtagtccacgcagtaaacgatgaacactaggtgtgcgggtcgaatgagatctgcgtgccacagcgaaagcgttaagtgttccacctggggagtacgccggcaacggtgaaactcaaaggaattgacgggggcccgcacaagcggaggaacatgtggtttaattcgatgatacgcgaggaaccttacccgggctcaaacggcagaggaaagtttttgaaaggaggctgctcttaggagtctctgccgaggtgctgcatggttgtcgtcagctcgtgccgtgaggtgtcggcttaagtgccataacgagcgcaacccctaccgccagttgccatcaggtaaagctggggactctggcgggactgccggcgcaagctgtgaggaaggcggggatgacgtcaaatcagcacggcccttacgtccggggcgacacacgtgttacaatggcaggtacagcgggaagccaccgagcgatcgggagcagaacccgaaaacctgtctcagttcggattggagtctgcaactcgactccatgaagctggattcgctagtaatcgcgcatcagccatggcgcggtgaatacgttcccgggccttgtacacaccgcccgtcaagccatggaagccgggggtgcctgaagtgcgcgaccgcaaggagcgccctaaggtaaaaccggtgactgg

SEQ ID NO: 304 - DNA, 1447 bp, Artificial Sequence
  Synthetic Polynucleotide
gctggcggcatgctttacacatgcaagtcgaacggcagcgcggggagcttgctccctggcggcgagtggcgcacgggtgagtaatacatcggaacgtgtcttctagtgggggataactgcccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgtattccgctgacggtacctgaagaataagcaccggctaactacgtgccagcagccgcggtaatacgtagggtgcaagcgttaatcggaactactgggcgtaaagcgtgcgcaggcggttctgtaagatagatgtgaaatccccgggctcaacctggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaaggcctgagagatcaggccgtgcccgcaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtcgataacgcccgaagtcagtgacccaaccgcaaggagggagctgccgaaggcgggattgataactgggg

SEQ ID NO: 305 - DNA, 1434 bp, Artificial Sequence
  Synthetic Polynucleotide
cgctggcggaacgctttacacatgcaagtcgaacctttacggggggaggagcttgctccagcccaacaacgagtggcgaacgggtgaggaatacatcggagcgtgaccgctcgtgggggacaaccagccgaaaggttggctaataccgcatgagttctacggaagaaagagggggacccgcaagggcctctcgcgagcggagcggccgatgactgattagcctgttggtgaggtaacggctcaccaaagcaacgatcagtagctggtctgagaggacgaccagccacactgggactgagacacggaccagactcctacgggaggcagcagtggggaattttggacaatgggcgcaagcctgatccagctattccgcgtgtgggatgaaggccctcgggttgtaaaccacttttgtagagaacgaaaagacatcttcgaataaaggatgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctctggcacgaaagcgtggggagcaaacaggattagatactctggtagtccacgccctaaacgatgttaactagttgttgggatgtaataatctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccttgacatgtcaggaagctcttgtaatgagagcgtgtccgcaagggagcctgaacacaggtggtgcatggctgtcgtcagctcgtgtcgtgagatgttgggttaagtcccgcaacgagcgcaatccttgtcactagttgcttcgaaagggcactctagtgagactgccggtgacaaaccggaggaaggtggggatgacgtcaagtcctcatggcccttatgggtagggcttcccacgtcatacaatggtcggaacagagggcagggaagccgtgaggcggagccaatcccagaaaaccgatcgtagtccggattgcagtttgcaacttgactgcatgaagttggaatcgctagtaatcgcggatcagcatgccgcggtgaatacgttcccgggtcttgtacaccccgcccgtcaaccaatgggagtggtgtttcccagaagtcgttagcctaaccgcaaggagggcggcgacc

SEQ ID NO: 306 - DNA, 1451 bp, Artificial Sequence
  Synthetic Polynucleotide
caggcctaacacatgcaagtcgaggggcagcggggaggtatcattacctctggtcggagggcggcgggcgggtgagtaacaagtatgcaatccacctgtagcaaggggataacccggataaatacggactaataccccataatatgggcgctccgcctggagagttcattaaagagagcaattttggttacagacgagcgtgcgctccattagccagttggggggggaacggcccaccaaagcgacgatggatgggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtacgctacgtgtagcgtattgcatgtatcctaagaaaaagcatcggctaactccgtgccagcagccgcggtaatacggaggatgcgagcgttatccggatttattgggtttaaagggagcgtaggcggcacgccaagtcagcggtgaaatttccgggctcaacccggagtgtgccgttgaaactggcgagctagagtacacaagaggcaggcggaatgcgtggtgtagcggtgaaatgcatagatatcacgcagaaccccgattgcgaaggcagccctgctagggtgaaacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatgtcggtgaaagccggcagctagtaatagtcacctgcgaggtgctgcatggttgtcgtcagctcgtgccgtgaggtgtcggcttaagtgccataacgagcgcaacccctatcgacagttactaacgggtgaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgtacacaccgcccgtcaagccatggaagccgggagtacctgaagcatgcaaccgcaaggagcgtacgaaggtaataccggtaactggggctaagtcataac

SEQ ID NO: 307 - DNA, 1409 bp, Artificial Sequence
  Synthetic Polynucleotide
ctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggacgatccccccgtgccgcagccaacgcattaagcgtcccgcctggggagtacggccgcaaggctaaaactcaagggaattgacgggggcccgcacaagcaacggagcatgtggcttaattccaaccaacgcgaagaacctttaccagggcttgacatatgggggaagcgggggagaccccgtggccgagaggagcccatacaggtggtgcatggctgtcgtcagctcgtgtcgtgagatgttgggttaagtcccgcaacgagcgcaacccccgccgcgtgtggccatcgggtgatgccgggaaccctcgggggaccgccgccgtcaaggcggaggaggggcgggggggacgtcaagtcatcatgccccttatgccctggggtgcacacgtgctacaatggccggtacagagggatgccaccccgcgagggggagcggatcccggaaagccggccccagttcggattgggggctgcaacccgcccccatgaagtcggagttgctagtaatcgcggatcagcaaccgcggggagaagcgttcccgggccttgtacacaccgcccgtcacaccacccgagtcgtctgcacccgaagtcgccggcccaaccgtcaaggggggaggcgccgaaggtgtgg

SEQ ID NO: 308 - DNA, 1550 bp, Artificial Sequence
  Synthetic Polynucleotide
gagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggaaagatgaaaggtggcctctatgtataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcaaatagttagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaactccgtgatgggatggaaactgctgatctagagtatcggagaggaaagtggaattcctagtgtagcggtgaaatgcgtagatattaggaagaacaccagtggcgaaggcgactttctggacgaacactgacgctgaggcgcgaaagccaggggagcgaacgggattagataccccggtagtcctggccgtaaacgatgggtactaggtgtaggaggtatcgaccccttctgtgccggagttaacgcaatagtacccgcctggggagtacgaccgcaaggttgaaactcaaaggaattgacgggggcccgcacagcggtggagtatgtggtttaatttgacgcaacgcgaagaaccttaccaggttttgaccttgatggacagaaccagagatggttccttttttttggaagcccgaaaaccggtggtgcacggttgttgtcagcttgtgtcgtgagatgttgggttaagtcctgcaacgagcgcaacccctattttatgttgccagcacgtaatggtgggaactcatgagagactgccgcagacaatgcggaggaaggcggggatgacgtcaaatcatcatgccccttatgacctgggctacacacgtaccacaatgggagttaatagacggaagcaagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggaacacct

SEQ ID NO: 309 - DNA, 1384 bp, Artificial Sequence; identical to SEQ ID NO: 174
  Synthetic Polynucleotide

SEQ ID NO: 310 - DNA, 1410 bp, Artificial Sequence
  Synthetic Polynucleotide
ctggcggcgtgcctaacacattgccagttcaaccgaaaagcgaccgaagccttgcttctatccattttagtggcgaacgggtgagtaacgcgtaatcaaccttgccccttcagagggggacaacagtttggaaacgaccgctaataccgcatacgattctaatctcggcatcgaggatagatgaaaggtggcctctacatgtaagctatcactgaaggaggggattcgcgtctgattagctagtttggaggggtaacggcccaccaaggcgatgattcagtagccggtctgagaggatgaacggccacattgggactgagacacggcccagactcctacgggaggcagcagtggggaatcttccgcaatggacgaaagtctgacggagcaacgccgcgtgagtgatgacggccttcgggtttgtaaagctctgttaatcgggacgaaaggccttcttgcgaatagtgagaaggatttgacggtaccggaatagaaagccacggctaactacgtgccagcagccgcggtaatacgtaggtggcaagcgttgtccggaatttattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacgtaaaggtgggaaactcatgagagactgccgcagacaatgcggaggaaggcggggatgacgtcaaatcatcatgccccttatgacctgggctacacacgtactacgatgggagttaatagacggaaagcgagaatcgcgagatggagcgaaacccgagaaaacgactctctcggtttcggatcggaggctgcgaactcgcctacgtgaaagttcggaatcgctagtgattcgcgggttcgggcacgactgcggtgaatgacgtttcccgggccttgt

SEQ ID NO: 311 - DNA, 1465 bp, Artificial Sequence
  Synthetic Polynucleotide
taacacatgcaagtcgaacgaagagcgatggcttcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggtccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtacaccgcctggggagtacgaccgcaaggttgaaactcaaaggaattgacggggggccgcacaagcggtggagtatgtggtttaattcgacgcaacgcgaagaaccttaccaggtcttgacattgatggacagaactagagatagttcgtattcttcggaaaccagaaaccaggtggcgcacggtggtcgtcagctcgtgtcgtgagatgttggattaagtcccgcaacgagcgcaacccctatcttatgtcgccagcacttcgggtgggaactcatgagagactgccgcagacaatgcggaggaaggcggggatgacgtcaaatcatcatgccccttatgacgtgggctacacacgttctacaatgggagttaatagagggaagcgaaaccgcgaggtggagcaaacccgagaaacactctctcagttcggatcgtagtctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttagggagccagccgtctaaggtaaagtcgatgattggggtga

SEQ ID NO: 312 - DNA, 1458 bp, Artificial Sequence
  Synthetic Polynucleotide
  misc_feature (929)..(929): n is a, c, g, or t
  misc_feature (1291)..(1291): n is a, c, g, or t
  misc_feature (1305)..(1305): n is a, c, g, or t
catgcaagtcgaacggagagatgagggagcttgctcctttagatcttagtggcgaacgggtgagtaacgcgtaatcaacctgcccttttgtgggggacaacagatggaaacgtctgctaataccgcatacgttcctgtggtcgcatgactataggaagaaaggtggcctctatttataagctaccgcaaaaggaggggattgcgtctgattagctagttggcggggtaatggcccaccaaggcgatgatcagtagccggtctgagaggatggacggccacattgggactgagacacggcccaaactcctacgggaggcagcagtggggaatcttccgcaatggacgaaagtctgacggagcaacgccgcgtgagtgatgaaggccttcgggttgtaaagctctgttaatcgggacgaaagagcgctgtgcgaatagtgtagcgaagtgacggtaccggaatagaaagccacggctaactacgtgccagcagccgcggtaatacgtaggtggcaagcgttgtccggaattattgggcgtaaagcgcgcgcaggcggatctgtaagtctgtcttaaaagttcggggctcaaccccgtgaggggatagaaactgcagatcttgagtatcggagaggaaagtggaattcctagtgtagcggtgaaatgcgtagagattaggaagaacaccagtggcgaaggcgactttctggacgaacactgacgctgaggcgcgaaagccaggggagcgaacgggattagataccccggtagtcctggccgtaaacgatgggtactaagtgtaggaggtatcgaccccttctgtgctgcagttaacgcaataagtaccccgcctggggagtacgaccgcaaggttgaaactcaaaggaattgacgggggcccgcacaagcggtggagtatgtggtttaattngacgcaacgcgaagaaccttaccaggtcttgacattgatggacgaagcaagagattgcttttctccttcgggagccagaaaacaggtggtgcacggctgtcgtcagctcgtgtcgtgagatgttgggttaagtcccgcaacgagcgcaacccctatcttatgttgccagcacgtaatggtgggaactcatgagagactgccgcggataacgcggaggaaggcggggatgacgtcaagtcatcatgccccttatgacctgggctacacacgtactacaatgggctttaacagagggacgcgaagccgcgaggtggagccaaccccagaaacaagctctcagttcggatcgtaggctgcaactngcctacgtgaagtnggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattgggg

SEQ ID NO: 313 - DNA, 1404 bp, Artificial Sequence
  Synthetic Polynucleotide
agagaagcttgcttttcttacgatcgagtggcaaacgggtgagtaacgcgtaaacaacctgccccgcagatggggacaacagctggaaacggctgctaataccgaatacggtcctcttagcgcatggtaagaggaagaaagggtggcctctggaacaagctaccgctgcgggaggggtttgcgtctgattagctggttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttataggggacgaacggccgggtagcgaagaggtagccggcatgacggtaccgtaagagaaagccacggctaactacgtgccagcagccgcggtaatacgtaggtggcaagcgttgtccggaatgattgggcgtaaagggcgcgcaggcggctgtgtaagtctgtccagaaagtgcggggctaaaccccgtgagaggatggaaactggacagctgagagtgtcggagaggaaagcggaattcctagtgtagcggtgaaatgcgtagatattaggaggaacaccggtggcgaaagcggctttctggacgacaactgacgctgaggcgcgaaagccaggggagcaaacgggattagataccccggtagtcctggccgtaaacgatgggtactaggtgtaggaggtatcgacccctcctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgctcgcaacgggtagagataccgggttcttcttcggaagacgagacaacaggtggtgcacggctgtcgtcagctcgtgtcgtgagatgttgggttaagtcccgcaacgagcgcaacccctatcttcagttaccagcacgtagcggtggggactcaggagagacagccgcagacaatgcggaggaaggcggggacgacgtcaagtcatcatgccccttatggcttgggctacacacgtactacaatggctctaaatagagggaggcgaaggagcgatccggagcaaaccccgcaaacagagtcccagttcggattgcaggctgcaactcgcctgcatgaaggaggaatcgctagtaatcgcaggtcagcatactgcggtgaatacgttcccgggccttgtacacaccgcccgtcacaccacgaaagtcattcacacccgaagccggtgaggtaaccgcaa

SEQ ID NO: 314 - DNA, 1402 bp, Artificial Sequence
  Synthetic Polynucleotide
gacgaacgctggcggcgtgcttaacacatgcaagtcaaacgaagagcgatggaagcttgcttctatcaatcttactggcgaacgggtgagtaacgcgtaatcaacctgcccttcagagggggacaacagttggaaacgactgctaataccgcatacgatctaatctcggcatcgaggatggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgtaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgacgccctatgagtcggagtcaacgcatcaagtaccccgcctggcgagtacgaccgcaaggttgaaactcaaaggaatagacgggggcccgcacaagcggtggagtatgtggtttaattcgacgcaacgcgaagaaccttaccaggtcttgacagtgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgtggaggaaggcggggacgacgtcaaatcatcatgccccttatgacctgggttacacatgtactacaaggggagttaatagacggaagcaataccgcgaggtggagcaagcccgagaaacactctctcagttcggattgtaggctgcaactcgcctacgcgaagtgggaatcggtagtaatcgcaggtcagcatactgcggagaatacgttcccgggccttgcacacaccgcccgtca

SEQ ID NO: 315 - DNA, 1387 bp, Artificial Sequence
  Synthetic Polynucleotide
gacgaacgctggcggcgtgcctaacacatgcaagtcgaacgagaagagaagagaagcttcgcttcttcatcaatttcgagtggcaaacgggtgagtaacgcgtaagcaacctgcccttcagatggggacaacagctggaaacggctgctaataccgaatacgttcatttcgccgcatgacgagatgaagaaagggaggccttcgggcttttcgctggaggaggggcttgcgtctgattagctggttggaggggtaacggcccaccaaggcgacgatcagtagccggtctgagaggatgaacggccacattgggactgagacacggcccagactcctacgggaggcagcagtggggaatcttccgcaatggacgaaagtctgacggaacaacgccgcgtgaacgatgacggccttcgggttgtaaagttctgttatatgggacgaacaggacatcggttaatacccggtgtctttgacggtaccgtaagagaaagccacggctaactacgtgccagcagccgcggtaatacgtaggtggcaagcgttgtccggaattattgggcgtaaagggcgcgcaggcggcatcgcaagtcggtcttaaaagtgcggggcttaaccccgtgaggggaccgaaactgtgaagctcgagtgtcggagaggaaagcggaattcctagtgcagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtaggaggtatcgactccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctacggaaagagatttccggttcttcttcggaagacaagaaaacaggtggtgcacggctgtcgtcagctcgtgtcgtgagatgttgggttaagtcccgcaacgagcgcaacccctatcttctgttgccagcacctcgggtggggactcagaagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggcct

SEQ ID NO: 316 - DNA, 1492 bp, Artificial Sequence
  Synthetic Polynucleotide
agagtttgatcctggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcccacctccgcatggaggcgggaggaaagatggcctctacttgtaagctatcgccagaagatgggcctgcgtctgattagctagtaggtggggtaacggctcacctaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgtcagggacgaatgtactgatttataatacacttcggtattgacggtacctgacgaggaagccacggctaactacgtgccagcagccgcggtaatacgtaggtggcaagcgttgtccggaattattgggcgtaaagagcatgtaggcgggcttttaagtccgacgtgaaaatgcggggcttaaccccgtatggcgttggatactgggagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaatcgggattagataccccggtagtcctggccgtaaacgatgggtactaggtgtaggaggtatcgaccccttctgtgccggagttaacgcaataagtaccccgcctggggactacgatcgcaagattgaaactcaaaggaattgacgggggcccgcacaagcggtggagtatgtggtttaattcgacgcaacgcgaagaaccttaccaaggcttgacattgagtgaaagacttagagataagtccccctcttcggaggcacgaaaacaggtggtgcatggctgtcgtcagctcgtgtcgtgagatgttgggttaagtcccgcaacgagcgcaacccttatcctatgttaccagcacgcaatggtggggactcataggagactgccagggataacctggaggaaggcggggatgacgtcaagtcatcatgccccttatgtcttgggctacacacgtactacaatggtcggcaacaaagggcagcgaagccgcgaggtggagcaaatcccagaaacccgaccccagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtctaaggtggggccgatga

SEQ ID NO: 317 - DNA, 1475 bp, Artificial Sequence
  Synthetic Polynucleotide
aacgctggcggcgtgcttaacacatgcaagtcgaacggggtgtttatttcggtaaacaccaagtggcgaacgggtgagtaacgcgtaagcaatctaccttcaagatggggacaacacttcgaaaggggtgctaataccgaatgaatgtaagagtatcgcatgagacacttactaaaggaggcctctgacataagcttccgcttgaagatgagcttgcgtctgattagctagttggtgagggtaaaggcccaccaaggcgacgatcggtagccggtctgagaggatgaacggccacattgggactgagacacggcccagactcctacgggaggcagcagtggggaatcttccgcaatgggcgaaagcctgacggagcaacgccgcgtgaacgatgaaggtcttaggatcgtaaagttctgttgttagggacgaagggtaagaatcataataaggtttttatttgacggtacctaacgaggaagccacggctaactacgtgccagcagccgcggtaatacgtaggcggcaagcgttgtccggaattattgggcgtaaagggagcgcaggcgggaaactaagcggatcttaaaagtgcggggctcaaccccgtgatggggtccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacgggattagataccccggtagtcctagccgtaaacgatggatactaggtgtgggaggtatcgacccctttcgtgccggagttaacgcaataagtataccgcttggggagtacggccgcaaggttgaaactcaaaggaattgacgggggaccgcacaagcggtggagtatgtggtgtaattcgacgcaacgcgaagaaccttaccaagacttgacattgattgaaagacttagagataagtccgttctcttcggagaacaagaaaacaggtggtgcatggctgtcgtcagcttgtgttgtgagatggtgggttaagtcccgcaacgagcgcaacccctatactatgttgccagcattacggatgggaactcatagtagactgccgcggacaacgcggaggaaggcggggatgacgtcaagtcatcatgccccttacgtcttgggttacacacgtactacaatgggatgaacagagggaagagaaatcgcgaggtggagcggatccctaaaagcatctctcagttcggattgtaggctgaaactcgcctacatgaagtcggaatcggtagtaatcgcaggtcagcatactgcggtgaatacgttcccgggccttgtacacaccgcccgtcacaccacgaaagtcattcacacccgaagccggataagggcctatggtaccgaccgtctaaggtgggggcgatgattggggtgaa

SEQ ID NO: 318 - DNA, 1374 bp, Artificial Sequence
  Synthetic Polynucleotide
tggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaaggcgacgatccatagccggcctgagatgatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaatggtccttgtgtgaataatgcaaggatttgacggtaccggaatagaaagccacggctaactacgtgccagcagccgcggtaatacgtaggtggcaagcgttgtccggaattattgggcgtaaagcgcgcgcaggcggtttcataagtctgtcttaaaagtgcggggcttaaccccgtgaggggatggaaactatggaactggagtatcggagaggaaagcggaattcctagtgtagcggtgaaatgcgtagatattaggaagaacaccagtggcgaaggcggctttctggacgacaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggccttaatagagggaagcgaaaccgcgaggtggagcaaaccccagaaacaagctctcagttcggatcgtaggctgcaactcgcctacgtgaagtcggaatcgctagtaatcgcaggtcagcatactgcggtgaatacgttcccgggccttgcac

SEQ ID NO: 319 - DNA, 1476 bp, Artificial Sequence; identical to SEQ ID NO: 26
  Synthetic Polynucleotide

SEQ ID NO: 320 - DNA, 1392 bp, Artificial Sequence
  Synthetic Polynucleotide
cggagccgaatgaaagcttgcttttatgagcttagtggcaaacgggtgagtaacacgtagacaacctgccgacaggatggggacaacattccgaaaggaatgctaataccgaatgaagtcagaggagggcatcctcctctgatgaaagatggcctctatatataagctatcacctgtcgatgggtctgcgtctgattagctggttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcggggtgcgaatagcactttgtaatgacggtacctgtcgaggaagccacggctaactacgtgccagcagccgcgttatacgtaggtggcgagcgttgtcggaatcattgggcgtaaagggagcgcaggcgggactggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagcgctagagatagcgtcctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggcctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccgg

SEQ ID NO: 321 - DNA, 1404 bp, Artificial Sequence
  Synthetic Polynucleotide
gacgaacgctggcggcgtgcttaacacgtgcaagtcgaacgaagagcgatggaagcttgcttctatcaatcttagtggcgaacgagtgagtaacgcgtaatcaacctgcccttcagagggggacaacagttggaaacgactgctaataccgcatacgatctaacctcggcatcgaggatagatgaaaggtggcctctatttataagctatcactgtaggaggggattgcgtctgattagctagttggaggggtaacggcccaccaaggcgatgatcagtagccggtctgagaggatgaacggccacatttggactgagacacggcccagacttctacgggaggcagcagtggggaatcttccgcaatggacgaaagtctgacggagcaacgccgcgtgagtgatgacggccttcgggttgtaaagctctgttaatcgggacgaaaagccttcttgcgaatagttagaaggattgacggtaccggaatagaaagccacggctaactacgtgccagcagccgcggtaatacgtaggtggcaagcgttgtccggaattattgggcgtaaagcgcgcgctggcggattggtcagtctgtcttaaaagttcggggcttaaccccgtgatgggatgggaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttcctgcgcggaagtaaagccattagtaacccgcctgggggggtcgacccgcaagggtgaaacttaaaggaattgaacgggggccggcacaagcggtggagtatgttgtttaattcgacgccacgcgaagaaccttaccaggtcttgacattgatggacagaactagagatagttcctctttttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtggatacgttcccgggccttgtactcaccgcccgtca

SEQ ID NO: 322 - DNA, 1414 bp, Artificial Sequence
  Synthetic Polynucleotide
gagtttgatcatggctcaggacgaacgctggcggcgtgcttaacacatgcaagtcgaacgaaaagacgggaagagcttgctctttccggaattgagtggcaaacgggtgagtaacacgtaaacaacctgccttcaggatggggacaacagacggaaacgactgctaataccgaataagttccaagggtcgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttgccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgagggagagcaaagctcaaaaacacgcccccagttcagtatcgcaggctgcgaacccgcctgcgtgaaagcgggaatcgctagtattcgcgggtcagctgaccgcggtgagtcgtttcccgggccttg

SEQ ID NO: 323 - DNA, 1413 bp, Artificial Sequence; identical to SEQ ID NO: 135
  Synthetic Polynucleotide

SEQ ID NO: 324 - DNA, 1417 bp, Artificial Sequence
  Synthetic Polynucleotide
agagtttgatcctggctcaggacgaacgctggcggcgtgcttaacacatgcaagtcgaacggggtgtttatttcggtaaacaccaagtggcgaacgggtgagtaacgcgtaagcaatctaccttcaagatggggacaacacttcgaaaggggtgctaataccgaatgaatgtaagagtatcgcatgagacacttactaaaggaggcctctgacataagcttccgcttgaagatgagcttgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgatgaaggtcttaggatcgtaaagttctgttgttagggacgaagggtaagaatcataataaggtttttatttgacggtacctaacgaggaagccacggctaactacgtgccagcagccgcggtaatacgtaggcggcaagcgttgtccggaattattgggcgtaaagggagcgcaggcgggaaactaagcggatcttaaaagtgcggggctcaaccccgtgatggggtccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacgggattagataccccggtagtcctagccgtaaacgatggatactaggtgtgggaggtatcgaccccttccgtgccggagttaacgcaataagtatcccgtctggggagtacggccgcaaggttgaaactcaaaggaattgacgggggcccgcacaagcggtggagtatgtggtttaattcgacgcaacgcgaagaaccttaccaagacttgacattgattgaaagacttagagataagtcccttctcttcggagaacaagaaaacaggtggtgcatggctgtcgtcagctcgtgtcgtgagatgttgggttaagtcccgcaacgagcgcaacccctatactatgttgccagcgcgtaatggcgggcactcacgggggaccgccggggccaacccggaggagggtggggacgacgtcaagtcatcatgccccccacggcctgggccgcacacgtgctacaatggccggcacagcgggctgcgaccccgcgagggggagcgaatcccacaaagccggccccagttcggaccgcaggctgcaacccgcctgcgcgaagccggagttgctagtaatcgcggatcagcacgccgcggtgaatgcgttcccgggccttgcacacaccgcccgtca

SEQ ID NO: 325 - DNA, 1493 bp, Artificial Sequence
  Synthetic Polynucleotide
tttgatcctggctcaggacgaacgctggcggcgtgcttaacacatgcaagtcgaacgagaggagaagagaagcttgcttcttttcgaatcgagtggcaaacgggtgagtaacacgtaaacaacctgccttcaggatggggacaacagacggaaacgactgctaataccgaatacgctcaaagggccgcatggcctattgaggaaagggtggcctctacctgtaagctatcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggttgcaggaataatactcctgtgaagtgacggtacccgaatagcaagccacggctaactacgtgccagcagccgcggtaatacgtaggtggcaagcgttgtccggaattattgggcgtaaagcgcgcgcaggcggcttcctaagtccatcttaaaagtgcggggcttaaccccgtgatgggatggaaactgggaagctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattgatcgctattccaagaaattggaagttctccttcgggagacgagaaaacaggtggtgcacggctgtcgtcagctcgtgtcgtgagatgttgggttaagttccgcaacgagcgcaacccctatcttatgttaccagcacgtcatggtggggactcatgagagaccgccgcgaacaacgcggaggaaggtggggatgacgtcaagtcatcatgccccttatgacctgggctacacacgtactacaatgggtgtcaacaaagaaaagcgaaaccgcgaggcagagcgaacctcaaaaacacacccccagttcagattgcaggctgcaacccgcctgcatgaagtaggaatcgctagtaatcgcgggtcagcataccgcggtgaatacgttcccgggccttgtacacaccgcccgtcacactatgagagtcagaaacacccgaagccggtgaggtaaccttcgggagccagccgtcgaaggtggagt

SEQ ID NO: 326 - DNA, 1450 bp, Artificial Sequence
  Synthetic Polynucleotide
gtgcttaacacatgcaagtcgaacgagaggagaaggaagcttgcttctttcaaatctagtggcaaacgggtgagtaacacgtaaacaacctgccttcaggatggggacaacagacggaaacgactgctaataccgaatacgttccttaggtcgcatgatcttaggaagaaagggtggcctctacttgtaagctatcgcctgaagaggggtttgcgtctgattaggtagttggtgaggtaacggcccaccaagccgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtcagcagacgaatactctgctgaagtgacggtacccgaatagccagccacggctaaactacgtgccagcagccgcggtaatacgtaggtggcaagcgttgtccggaattattgggcgtaaaggcgcgcgcaggcggcttcttaagtccatcttaaaagtgcggggcttaaccccgtgatgggatggaaactgagaggctggagtatcggagaggaaagtggaattcctagtgtagcggtgaaatgcgtagagattaggaagaacaccggtggcgaaggcgactttctggacgacaactgacgctgaggcgcgaaagcgtggggagcaaacagaattagataccctggtagtccacgccgtaaacgatgaatactaggtgtaggaggtatcgaccccttctgtgccggagtctaacacaataagtattccgtcctgggaagtagatcgcgagatttaaattcaaaggaaatgacgggggccgcacaagcggtggagtatgggtttaatttgagaggaagaaccttaccaggtgttgacattgatcggtattccaagaaattggaagttcctcttcggaggaggagaaaacaggtggtgcacggctgtcgtcaggtgtgtcgtgagatgttgggttaagtcccgcaacgagcgcaacccctatcttatgttaccagcacgttatggtggggactcatgagagaccgccgcggacaacgcggaggaaggtggggatgacgtcaagtcatcatgccccttatgacctgggctacacacgtactacaatgggtgtcaacaaagagaagcgaagccgcgaggcagagcaaacctcaaaaacacacccccagttcagattgcaggctgcaacccgcctgcatgaagtaggaatcgctagtaatcgcgggtcagcataccgcggtgaatacgttcccgggccttgtacacaccgcccgtcacactatgagagtcagaaacacccgaagccggtgaggtaaccgtcaaggagccagccgtcgaaggt

SEQ ID NO: 327 - DNA, 1527 bp, Artificial Sequence
  Synthetic Polynucleotide
agagtttgatcctggctcaggacgaacgctggcggcgtgcttaacacatgcaagtcgaacgaggggaagagggagcttgcttcttccgaacctagtggcaaacgggtgagtaacacgtaaacaacctgccttcaggatggggacaacagacggaaacgactgctaataccgaataccttcctatcaccgcatgatgaaaggaagaaagggtggcctctacctgtaagctatcgcctgaagaggggtttgcgtctgattaggtagttggtgaggtaatggcccaccaagccgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaatagcagggaagccaatacctttcctgaatgacggtacccgaatagcaagccacggctaactacgtgccagcagccgcggtaatacgtaggtggcaagcgttgtccggaattattgggcgtaaagcgcgcgcaggcggcttcctaagtccatcttaaaagtgcggggcttaaccccgtgatgggatggaaactgggaagctggagtatcggagaggaaagtggattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctaggaagtacgatcgcaagattaaaactcaaaggaattgacgtgggcccgcacaagcggtggagtatgtggtttaattcgacgcaacgcgaagaaccttaccaggtcttgacattgatcgctatccgcagaaatgtggagttcctcttcggaggacgagaaaacaggtggtgcacggctgtcgtcagctcgtgtcgtgagatgttgggttaagtcccgcaacgagcgcaacccctatcttatgttgccagcacgcaaaggtgggaactcatgagagaccgccgcggacaacgcggaggaaggtggggatgacgtcaagtcatcatgccccttatgacctgggctacacacgtactacaatgggtgtcaacaaagagaagcaaagcagcgatgcagagcaaacctcaaaaacacacccccagttcagattgcaggctgcaacccgcctgcatgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtaacc

SEQ ID NO: 328 - DNA, 1485 bp, Artificial Sequence
  Synthetic Polynucleotide
gaacgctggcggcgtgcttaacacatgcaagtcgaacgagaagagatgagaagcttgcttcttattaattctagtggcaaacgggtgagtaacgcgtaagcaacctgcccttcagatggggacaacagatggaaacggctgctaataccgaatacgttcatttcgccgcatgacgggatgaagaaagggaggccttcgggcttccgctggaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatatgggacgaacaggacatcggttaatacccggtgtctttgacggtaccgtaagagaaagccacggctaactacgtgccagcagccgcggtaatacgtaggtgacaagcgttgtccggaattattgggcgtaaagggcgcgcaggcggcatcgcaagtcggtcttaaaagtgcggggcttaaccccgtgaggggaccgaaactgtgaagctcgagtgtcggagaggaaagcagaattcctagtgtagcggtgaaatgcgtagatattaggaggaacaccagtggcgaaagcggctttctggacgacaactgacgctgaggcgcgaaagccaggggagcaaacgggattagataccccggtagtcctggccccgtaacgatgggatactaggtgtaggaggtatcgactccttcggagctggagttaacgcattaagtgtaccgggtgggggagtacggctgcaaggttgaaattcaaaggaattgacggggggcccgcacaaaccggtggagtatgtggttgaattccgacgcaacgcgaagaaccttaccaagccttgacattgattgctacggaaagagatttcgggttcttattcggaagacaagaaaacaggtggtgcacggctgtagtcagctcgtgtcgtgagatgttgggttaagtcccgcaacgagcgcaacccctatcttctgttgccagcacctcgggtggggactcagaagagactgccgcagacaatgcggaggaaggcggggatgacgtcaagtcatcataccccttatggcttgggctacacacgtactacaatggctcttaatagagggaagcgaaggagcgatccggagcaaaccccaaaaacagagtcccagttcggattgcaggttgcaactcgcctgcatgaagcaggaatcgatagtaatcgcaggtcagcatactgcggtgaatacgttcccgggccttgtacacaccgcccgtcacaccacgaaagtcattcacacccgaagccggtgaggcaaccgcaaggaaccagccgtcgaaggtgggggcgatgattgggg

SEQ ID NO: 329 - DNA, 1511 bp, Artificial Sequence
  Synthetic Polynucleotide
gacgaacgctggcggcgtgcctaacacatgcaagtcgaacggagtgtttatttataaacacttagtggcgaacgggtgagtaacgtgtagacaacctaccctctagatggggacaacaccgcgaaagtggtgctaataccgaatgttgtaatgttattgcataatgatattactaaaggtggcctctatataaaagctaccgctagaagatgggtctgcgtctgattagctagttggtgagataacagctcaccaaggcaatgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaagctctgtcttcaaggacgaatgtagatattgtgaataatgatatttaatgacggtacttgaggaggaagccacggctaactacgtgccagcagccgcggtaatacgtaggtggcaagcgttgtccggaattattgggcgtaaagggagcgcaggtgggaatatcagtctgtcttaaaagttcggggctcaaccccgtgatgggatggaaactatatttcttgagtgcaggagaggaaagtggaattcctagtgtagcggtgaaatgcgtagatattaggaggaacaccagtggcgaaggcgactttctggactgtaactgacactgaggctcgaaagccagggtagtgaacgggattagataccccggtaatcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagacttgacattgattgaaaagctaagagattagctcctcttcttcggaagacaagaaaacaggtggtgcatggctgtcgtcagctcgtgtcgtgagatgttgggttaagtcccgcaacgagcgcaacccctatcctatgttgccagcaagtaatgkygggaactcatgggagactgccgcagacaatgcggaggaaggcggggatgacgtcaagtcatcatgccccttatgtcttgggctacacacgtactacaatggacttaaatagagggaagcaataccgcgaggtggagccaaacccagaaacaagttctcagttcggattgtaggctgcaactcgcctacatgaagtcggaatcgctagtaatcgcaggtcagcatactgcggtgaatacgttcccgggccttgtacacaccgcccgtcacaccacgaaagtcagtcacacccaaagccggtgagataaccgtaaggagtcagccgtctaaggtggggccgatgattggggtgaagtcgtaacaaggtagccgtatcggaaggtgc

SEQ ID NO: 330 - DNA, 1371 bp, Artificial Sequence; identical to SEQ ID NO: 164
  Synthetic Polynucleotide

SEQ ID NO: 331 - DNA, 1423 bp, Artificial Sequence
  Synthetic Polynucleotide
gagtttgatcatggctcaggacgaacgctggcggcgtgcttaacacatgcaagtcgaacggagcgaatgaaagcttgcttttatgagcttagtggcaaacgggtgagtaacacgtagacaacctgccgataggatggggacaacattccgaaaggaatgctaataccgaatggcgtgtaggggaggcatctcccgtacatgaaagatggcctctgaatatgctatcacctatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaaggggacgaacgtatatagtgcgaatagtgctgtgtaatgacggtaccttttgaggaagccacggctaactacgtgccagcagccgcggtaatacgtaggtggcgagcgttgtccggaatcattgggcgtaaagggagcgcaggcggccatgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggtcttgacattgattgaaaggcgtagagatacgtccctctcttcggagacaagaaaccaggtggtgcatggctgtcgtcagctcgtgtcgtgagatgttgggttaagtcccgcaacgagcgcaacccctgtcctttgttgccagcatgtagtggtgggcactcaaaggagactgccgcggagaacgcggaggaaggcggggatgacgtcaagtcatcatgccccttatgacctgggctacacacgtactacaatgggacggacagagagcagcgagagggcgaccttaagcgaaacctcaaaaaccgtttctcagttcggattgcaggctgcaaactcgcctgcatgaaagtcggaaatcgctagtaatcgcaggtcagcatactgcggtgaaatacgttcccgggttcttgtacacaccgcccgtca

SEQ ID NO: 332 - DNA, 1385 bp, Artificial Sequence
  Synthetic Polynucleotide
gacgaacgctggcggcgtgcttaacacatgcaagtcgaacgggattttgagaagcttgcttcttgagattcagtggcaaacgggtgagtaacgcgtaaacaacctgccttcaggatggggacaacagacggaaacgactgctaataccgaatacgttcttggttccgcatgggataaggaagaaaggatggcctctcgaagaagctatcgcctgaagaggggtttgcgtctgattaggcagttggcggggtaacggcccaccaaaccaacgatcagtagccggtctgagaggatgaacggccacactggaactgagacacggtccagactcctacgggaggcagcagtggggaatcttccacaatgggcgaaggcctgatggagcaacgccgcgtgagtgatgaaggccttcgggttgtaaagctctgttattcgggacgaaagagcgcacggctaatatccatgcgaagtgacggtaccgaaaaagaaagccacggctaactacgtgccagcagccgcggtaatacgtaggtggcaagcgttgtccggaattattgggcgtaaagcgcgcgcaggcggccttttaagtccatcttaaaagcgtggggctcaaccccatgaggggatggaaactgggaggctggagtatcggagaggaaagcggaattcctagtgtagcggtgaaatgcgtagagattaggaagaacaccagtggcgaaggcggctttctggacgacaactgacgctgaggcgcgaaagcgtggggagcaaacaggattagataccctggtagtccacgccgtaaacgatggatactaggtgtaggaggtatcgaccccttctgtgccggagctaacacaataagtatcccgcctgggaagtacggccgcaaggctaaaactcaaaggaattgacgggggcccgcacaagcggtggagtatgtggtttaattcgacgcaacgcgaagaaccttaccaagtcttgacattgatcgcaatccctggaaacagggagttctccttcgggagacgagaaaacaggtggtgcacggctgtcgtcagctcgtgtcgtgagatgttgggttaagccccgcaacgagcgcaacccctatcttctgttaccagcacgccatggtggggactcaggagagactgccgcagacaatgcggaggaaggcggggatgacgtcaagtcatcatgccccttatgacttgggctacacacgtactacaatgggctttaacaaagagcagcgaaggagcgatccggagcgaacctcaaaaacaagccctcagttcagatcgcaggctgcaacccgcctgcgtgaaggcggaatcgctagtaatcgcgggtcagcataccgcggtgaatacgttcccgggcct

SEQ ID NO: 333 - DNA, 1482 bp, Artificial Sequence
  Synthetic Polynucleotide
ttcgcccttagagtttgatcctggctcaggacgaacgctggcggcgtgcttaacacatgcaagtcgaacgagaagagatgagaagcttgcttcttatcaattcgagtggcaaacgggtgagtaacgcgtaagcaacctgcccttcagatggggacaacagctggaaacggctgctaataccgaatacgttctttttgtcgcatggcagagggaagaaagggaggctcttcggagctttcgctgaaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatacgggacgaatggcgtagcggtcaatacccgttacgagtgacggtaccgtaagagaaagccacggctaactacgtgccagcagccgcggtaatacgtaggtggcaagcgttgtccggaattattgggcgtaaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacggcaactgacgctgaggcgcgaaagccaggggagcaaacgggattagataccccggtagtcctggccgtaaacgatggatactaggtgtaggaggtatcgaccccttctgtgccggagttaacgcaataagtatcccgcctggggagtacagccgcaaggctgaaactcaaaggaattgacgggggcccgcacaagcggtggagtatgtggtttaattcgacgcaacgcgaagaaccttaccaagccttgacattgattgctatggatagagatatccagttcctcttcggaggacaagaaaacaggtggtgcacggctgtcgtcagctcgtgtcgtgagatgttgggttaagtcccgcaacgagcgcaacccctatcttctgttaccagcgagttaagtcggggactcaggagagactgccgcggacaatgcggaggaaggcggggatgacgtcaagtcatcatgccccttatggcttgggctacacacgtactacaatggctcttaatagagggaagcgaaggagcgattcggagcaaaccccaaaaacagagtcccagttcggattgcaggctgcaactcgcctgcatgaagcaggaatcgctagtaatcgcaggtcagtcatactgcggtgaatacgttcccgggtccttgttacacaccgtcccgttcacaccacgaaagttcattcacacccgaagccggtgaggtaacctt

SEQ ID NO: 334 - DNA, 1415 bp, Artificial Sequence
  Synthetic Polynucleotide
agagtttgatcctggctcaggacgaacgctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtcctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaaaggcggggactcataggagactgccagggataacttggaggaaggcggggatgacgtcaagtcatcatgccccttatgtcttgggctacacacgtactacaatggtcggcaacaaagggcagcgaaaccgcgaggtggagcaaatcccaaaaataacgtcccagttcggattgtagtctgcaactcgactacatgaagctggaatcgctagtaatcgcgaatcagaatgtcgcggtgaatacgttcccgggtcttgcacacaccgcccgtca

SEQ ID NO: 335 - DNA, 1411 bp, Artificial Sequence; identical to SEQ ID NO: 162
  Synthetic Polynucleotide

SEQ ID NO: 336 - DNA, 1527 bp, Artificial Sequence
  Synthetic Polynucleotide
agagtttgatcctggctcaggacgaacgctggcggcgtgcttaacacatgcaagtcgaacgggaggacatgggaagcttgcttcctgtggactctagtggcaaacgggtgagtaacgcgtaagcaacctgccctccggatggggacaacagctggaaacggctgctaataccgaatacgtttctgatgccgcatggcatgggaaagaaaggtggcctctgaatatgctaccgccggaggaggggcttgcgtctgattagctggttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagcgaagacggccttcgggttgtaaagccctgttatacgggacgaacgggggagtggttaatatccattttcagtgacggtaccgtaagagaaagccacggctaactacgtgccagcagccgcggtaatacgtaggtggcaagcgttgtccggaattattgggcgtaaagggcgcgcaggcggtttcataagtctgtcttaaaagtgcggggcttaaccccgtgaggggacggaaactgtgagactggagtgtcggagaggaaagcggaattcctagtgtagcggtgaaatgcgtagatattaggaggaacaccagtggcgaaagcggctttctggacgacaactgacgctgaggcgcgaaagccaggggagcgaacgggattagataccccggtagtcctggccgtaaacgatggatactaggtgtagggggtatcgacccctcctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgagtgccatcctcagagatgaggagttcttcttcggaagacgcgaaaacaggtggtgcacggctgtcgtcagctcgtgtcgtgagatgttgggttaagtcccgcaacgagcgcaacccctatcttctgttgccagcacgttatggtggggactcaggagagactgccgcagacaatgcggaggaaggcggggatgacgtcaagtcatcatgccccttatggcttgggctacacacgtactacaatggctcttaatagagggacgcgaaggagcgatccggagcaaaccccaaaaacagagtcccagttcggattgcaggctgcaacccgcctgcatgaagcaggaatcgctagtaatcgcaggtcagcatactgcggtgaatacgttcccgggccttgtacacaccgcccgtcacaccacgaaagtcattcacacccgaagccggtgaggtaaccttacggagccagccgtcgaaggtgggggcgatgattggggtgaagtcgtaacaaggtagcc

SEQ ID NO: 337 - DNA, 1448 bp, Artificial Sequence
  Synthetic Polynucleotide
gacgaacgctggcggcgtgcttaacacatgcgagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcagcgccgcgtgagcgatgacggccttcgggttgtaaagctctgttaatcgggacgaaaggccttcttgcgaatagtgagaaagattgacggtaccggaatacaaagccacggctaactacgtgccagcagccgcggtaatacgtacgtggtaagcgttgtccggaattattgggcgtaaagcgcgcgcatgcggataggtcactctgtcttaaaagttcggggcttaacccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggcggagtatgtagtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacgtaaaggtgggaactcatgagagactgccgcagacaatgcggaggaaggcggggatggcgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgatagtaatcgcaggtcagcatacttcggtgaatacgttcccgggccttgtacacaccgcccgtcacaccacgaaagtcgggggtacctgaagtgcgtaaccgcgaggag

SEQ ID NO: 338 - DNA, 1425 bp, Artificial Sequence
  Synthetic Polynucleotide
gagtttgatcctggctcaggacgaacgctggcggcgtgcttaacacatgcaagtcgaacgagaagagatgagaagcttgcttcttatctcttcgagtggcaaacgggtgagtaacgcgtaagcaacctgcccttcagatggggacaacagctggaaacggctgctaataccgaatacgttccttctgccgcatgacagagggaagaaagggaggctcttcggagctttcgctgaaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatacgggacgaatggcgtaacggtcaatacccgttacgagtgacggtaccgtaagagaaagccacggctaactacgtgccagcagccgcggtaatacgtaggtggcaagcgttgtccggaattattgggcgtaaagggcgcgcaggcggtctggtaagtcggtcttaaaagtgcggggcttaaccccgtgaggggaccgaaactgccagactagagtatcggagaggaaagcggaattcctagtgtagcggtgaaatgcgtagatattaggaggaacaccagtggcgaaagcggctttctggacgacaactgacgctgaggcgcgaaagccaggggagcaaacgggataagataccccggtagtcctggccgtaaacgagggatactaggggtaggagggtatcggccccttctgtgccggagttaacgcaataaattatcccgcctgggggagtacggccgcaaggctgaaactcaaaggaattgacgggggcccgcacaagcggtggagtatgtggtttaattcgacgcaacgcgaagaaccttaccaagccttgacattgattgctagggaaagagatttcccgttcttcttcggaagacatgaaaacaggtggtgcacggctgtcgtcagctcgtgtcgtgagatgttgggttaagtcccgcaacgagcgcaacccctatcttctgttaccagcggtccggccggggactcaggagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtca

SEQ ID NO: 339 - DNA, 1519 bp, Artificial Sequence
  Synthetic Polynucleotide
agagtttgatcctggctcaggacgaacgctggcggcgtgcttaacacatgcaagtcgtacgagacgattgaaagcttgcttttgaaagtcgagtggcaaacgggtgagtaacgcgtagacaacctgccgtaaagatggggacaacagttcgaaaggactgctaataccgaatgttgtagagtttccgcatgggaatcctattaaaggtggcctctacttgtaagctatcgctttacgatgggtctgcgtctgattagctagttggtggggtaacggcttaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtcaggactcaaaatatgggttctgaatgacggtacctgacgaggaagccacggctaactacgtgccagcagccgcggtaatacgtaggtggcgagcgttgtccggaattattgggcgtaaagggagcgcaggcgggaaggtaagtctatcttaaaagtgcggggctcaaccccgtgaggggatggaaactatctttcttgagtacaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaagggctagagatagtcccctctcttcggagacacgaaaacaggtggtgcatggctgtcgtcagctcgtgtcgtgagatgttgggttaagtcccgcaacgagcgcaacccctatcctttgttgccagcacgcaatggtgggaactcaaaggagactgccgcggacaacgcggaggaaggcggggatgacgtcaagtcatcatgccccttatgtcctgggctacacacgtactacaatgggatggacagagagcagcgaagccgcgaggccaagcgaaccccataaaccatctcccagttcggattgcaggctgcaacccgcctgcatgaagttggaatcgctagtaatcgcaggtcagcatactgcggtgaatgcgttcccgggccttgtacacaccgcccgtcacaccacggaagtcattcacacccgaagccggcaggctaaccgcaaggaggcagccgtctaaggtgggggcgatgactggggtgaagtcgtaacaaggta

SEQ ID NO: 340 - DNA, 1405 bp, Artificial Sequence; identical to SEQ ID NO: 129
  Synthetic Polynucleotide

SEQ ID NO: 341 - DNA, 1468 bp, Artificial Sequence
  Synthetic Polynucleotide
aacacatgcaagtcgaacgaaaggaatctttagcttgcttttttctgaattgagtggcaaacgggtgagtaacacgtaaacaacctgccttcaggatggggacaacagacggaaacgactgctaataccgaatacgttccacagagcgcatgctttatggaagaaagggtggcctctacctgtaagctatcgcctgaagaggggtttgcgtctgattaggcagttggcggggtaacggcccaccaaaccgacgatcagtagccggtctgagaggatgaacggccacactggaactgagacacggtccagactcctacgggaggcagcagtggggaatcttccgcaatgggcgaaagcctgacggagcaacgccgcgtgagtgaagacggccttcgggttgtaaagctctgtgatccgggacgaaagagcgccatacgaagaatatggcgaagtgacggtaccgtagaagaaagccacggctaactacgtgccagcagccgcggtaatacgtaggtggcaagcgttgtccggaattattgggcgtaaagggcgcgcaggcggcctcttaagtccatcttaaaagagcggggcttaaccccgttatgggatggaaactgagaagctggagtatcggagagggaagtggaatttctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatggatactaggtgtaggaggtatcgaccccttccgtgccggagttaacgcaataagtaccccgcctggggagtacggccgcaaggttgaaactcaaaggaattgacgggggctcgcacaagcggtggagtatgtggtttaattcgacgcaacgcgaagaaccttaccaggtcttgacattgatcgcaatcttaagaaattaagagtttcccttcggggaacgagaaaacaggtggtgcacggctgtcgtcagctcgtgtcgtgagatgttgggttaagtcccgcaacgagcgcaacccctatcatttgttgccagcacgtaaaggtggggactcaaatgagaccgccgcggacaacgcggaggaaggtggggacgacgtcaagtcatcatgccccttatgacctgggctacacacgtactacaatgggtgtcaacaaagagaagcgaagccgcgaggcggagccaaccccaaaaacacacccccagttcggattgcaggctgcaacccgcctgcgtgaagtaggaatcgctagtaatcgcgggtcagcataccgcggtgaatacgttcccgggccttgtacacactgcccgtcacactatgagagtcagaagcacccgaagccggtgaggtaaccgcaaggagccagccgtcgaaggcggagctgatgattggagtg

SEQ ID NO: 342 - DNA, 1405 bp, Artificial Sequence; identical to SEQ ID NO: 202
  Synthetic Polynucleotide

SEQ ID NO: 343 - DNA, 1425 bp, Artificial Sequence
  Synthetic Polynucleotide
agagtttgatcctggctcaggacgaacgctggcggcgtgcttaacacatgcaagtcgaacgaaaagacggaaagagcttgctcttctcagaattgagtggcaaacggctgagtaacacgtaaacaacctgccttcaggatggggacaacagacggaaacgactgctaataccgaataagttccaagggccgcatggcccatggaagaaaaggtggcctctacctgtaagctatcgcctgaagaggggtttgcgtctgattagctggttggaggggtaacggcccaccaaggcgacgatcagtagccggtctgagaggatgagcggccacactggaactgagacacggtccagactcctacgggaggcagcagtggggaatcttccgcaatgggtgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatgaatgctaggtgctggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggtccgtaacggggccttctcttcggagcattggagacaggtggtgcatggttgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgagggagagcaaagctcaaaaacacacccccagttcagatcgcaggctgcaacccgcctgcgtgaagtaggaatcgctagtaatcgcgggtcagcataccgcggtgaatacgttcccgggccttgtacacaccgcccgtca

SEQ ID NO: 344 - DNA, 1456 bp, Artificial Sequence
  Synthetic Polynucleotide
cttacacatgcagtcgaacgggaagagatgaagagcttgctctttatcgaatccagtggcaaacgggtgagtaacacgtaaacgacctgccttcaggatggggacaacagacggaaacgactgctaataccgaatacgttccacgggccgcatgacctgtggaagaaagggtagcctctacctgtaagctatcgcctgaagaggggtttgcgtctgattaggcagttggtggggtaacggcccaccaaaccaacgatcagtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgatccgggacgaaagagcctgaggtgaatagcctaaggaagtgacggtaccggaaaagcaagccacggctaactacgtgccagcagccgcggtaatacgtaggtggcaagcgttgtccggaattattgggcgtaaagcgcgcgcaggcggcttcctaagtccatcttaaaagtgcggggcttaaccccgtgatgggatggaaactgggaagctggagtatcggagaggaaaggtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggataggggggggggtgggggctccccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcaattttcagaaatgagaagttctccttcgggagacgagaaaacaggtggtgcacggctgtcgtcagctcgtgtcgtgagatgttgggttaagtcccgcaacgagcgcaacccctatcatttgttgccagcacgtaaaggtggggactcaaatgagaccgccgcagacaatgcggaggaaaggtggggatgacgtcaagtcatcatgccccttatgacctgggctacacacgtactacaatgggtgtcaacaaagagaagcgaaagggcgacctggagccaacctcaaaaacacacccccagttcagatcgcaggctgcaactcgcctgcgtgaagcaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcgag

SEQ ID NO: 345 - DNA, 1418 bp, Artificial Sequence
  Synthetic Polynucleotide
agagtttgatcctggctcaggacgaacgctggcggcgtgcttaacacatgcaagtcgaacggggtgtttatttctgaaaacaccaaatggctaacgggtgagtaacgcgtaaacaatctaccttcaagatggggacaacacttctgaaaggggtgttaataccgaatgaatgtaagagtatcccatgagacacttactaaaggaggcctctgaaaatgcttccacttgaagatgagcttgcgtctgattagctagttggtgagggtaaaggcccaccaaggcgacgatcaataaccggtctgagaggatgaacggccacattgggactgagacacggcccagactcctacgggaggcagcagtggggaatcttctgcaatgggcgaaagcctgacggagcaacgccgcgtgaacgaagaaggtcttaggatcgtaaagttctgtggttagggacgaagggtaagaatcataatacggtttttatttgacggtacctaacgaggaagccacggctaactacgtgccagcagccgcggtaatacgtaggcggcaagcgttgtccggaattattgggcgtaaagggagcgcaggcgggaaactaagtggatcttaaaagtgcggggctcaacctcgtgatggggtccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacaggattagataccccggtagtcctagccgtaaacgatggatactaggtgtgggaggtatcgaccccttccgcgccggagttaacgcaataagtatcccgcctggggagtacggccagcaaggttgaaactcaaaggaattgacgggggcccgcacaagcgctcgagtatgtggtttaattggacgcaacgcgaagaaccttaccaacacttgcacagtgattgaaagacttagagataagtccgttctattcggagaacaagaaaccaggtggtgcatggcagtcgtcagctcgtgtcgtgtgatgttgggttaagtcccgcaacgagcgcaacccctacgttatgttgccagcattacggaggggaactcatagtagactcccgcggacaacgcggaggaaggcggggaggacgtcaagtcttcatgccccttacgtcttgggctccacacgtattccaatgggatgaacagagggaagcgaaatcgcgaggcggagcggatccctaaaagcatctctcagttcggattgtaggctgaaactcgcctacatgaagtcggaatcgctagtaatcgcaggtcagcatactgcggtgaatacgttcccgggccttgcacacaccgcccgtca

SEQ ID NO: 346 - DNA, 1465 bp, Artificial Sequence
  Synthetic Polynucleotide
aacacatgcaagtcgaacgggaagagatgaagagcttgctctttatcaaatccagtggcaaacgggtgagtaacacgtaaacaacctgccttcaggatggggacaacagacggaaacgactgctaataccgaatacgttccacgggccgcatgacctgtggaagaaagggtagcctctacctgtaagctatcgcctgaagaggggtttgcgtctgattaggcagttggtggggtaacggctcaccaaaccaacgatcagtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgatccgggacgaaagagcctgaggtaaatagcctaaggaagtgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcattcgttgccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaaaccgcgaggaagagcaaacctcaaaaacacacccccagttcagatcgcaggctgcaacccgcctgcgtgaagcaggaatcgctagtaatcgcgggtcagcataccgcggtgaatacgttcccgggccttgtacacaccgcccgtcacactatgagagtcagaaacacccgaagccggtgaggtaaccacaaggagccagccgtcgaaggcggagctgatgattgg

SEQ ID NO: 347 - DNA, 1520 bp, Artificial Sequence; identical to SEQ ID NO: 283
  Synthetic Polynucleotide

SEQ ID NO: 348 - DNA, 1411 bp, Artificial Sequence; identical to SEQ ID NO: 126
  Synthetic Polynucleotide

SEQ ID NO: 349 - DNA, 1415 bp, Artificial Sequence
  Synthetic Polynucleotide
tggctcaagataaacgcctggcggtgtacataagacacgcaagtcgaacgggagaagacaggaagatctatctacttcgttggacaccgtggcggacgggtgagtaacacgtaatcaacctgcccttcagagggggacaacagttggaaacgactgctaataccgcatacgatctaacctcggcatcgaggatggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtc

SEQ ID NO: 350 - DNA, 1397 bp, Artificial Sequence; identical to SEQ ID NO: 193
  Synthetic Polynucleotide

SEQ ID NO: 351 - DNA, 1406 bp, Artificial Sequence
  Synthetic Polynucleotide
cgcgcttcacacacgcaagtccgaaacgagagcgtcgagaaagccttcgcttttttcacaatctagcggcaaacgggcgagtaacgcgtaaacaacccgccctacggacggggaacaacagctcggaaacggctcgctaataccgaatacgtctccgaaagtcgcatgactcgtcggaaagaaaggatggcctctatttataagctatcgccggaggaggggtttcgcgtctgattagctagttggaggggtaacggcccaccaaggcgacgattcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatacgggacgaatagtcttgtggttaatacccatgagaagtgacggtaccgtaagagaaagccacggctaactacgtgccagcagccgcggtaatacgtaggtggcaagcgttgtccggaattattgggcgtaaagggcgcgcaggcggcttcttaagtctgtcttaaaagtgcggggcttaaccccgtgatgggatggaaactgggaagctcagagtatcggagagggaagcggaattcctagtgtagcggtgaaatgcgtagatattaggaggaacaccagtggcgaaagcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgatcgcaaggagtagagatactctgttcttcttcggaagacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtctcagttcggattgtaggctgcaactcgcctacatgaagcaggaatcgctagtaatcgcaggtcagcatactgcggtgaatacgttcccgggccttgcacacaccgcccgtca

SEQ ID NO: 352 - DNA, 1432 bp, Artificial Sequence
  Synthetic Polynucleotide
  misc_feature (37)..(37): n is a, c, g, or t
  misc_feature (419)..(419): n is a, c, g, or t
  misc_feature (919)..(919): n is a, c, g, or t
  misc_feature (948)..(948): n is a, c, g, or t
  misc_feature (951)..(951): n is a, c, g, or t
  misc_feature (953)..(953): n is a, c, g, or t
  misc_feature (961)..(961): n is a, c, g, or t
  misc_feature (968)..(968): n is a, c, g, or t
  misc_feature (983)..(984): n is a, c, g, or t
  misc_feature (991)..(991): n is a, c, g, or t
  misc_feature (997)..(997): n is a, c, g, or t
  misc_feature (1030)..(1030): n is a, c, g, or t
  misc_feature (1035)..(1035): n is a, c, g, or t
  misc_feature (1038)..(1038): n is a, c, g, or t
  misc_feature (1043)..(1043): n is a, c, g, or t
  misc_feature (1094)..(1094): n is a, c, g, or t
agtcgaacgagaagagatgagaagcttgcttcttatngattcgagtggcaaacgggtgagtaacgcgtaagcaacctgcccttcagatggggacaacagctggaaacggctgctaataccgaatacgttctttttgtcgcatggcagagggaagaaagggaggctcttcggagctttcgctgaaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatacgggacgaatggcgtancggtcaatacccgttacgagtgacggtaccgtaagagaaagccacggctaactacgtgccagcagccgcggtaatacgtaggtggcaagcgttgtccggaattattgggcgtaaagggcgcgcaggcggcgtcgtaagtcggtcttaaaagtgcggggcttaacccccgtgaggggaccgaaactgcgatgctagagtatctggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtaggaggtatcgaccccttctgtgccggaagttaacgcaataagtatcccgcctgggggagtacggccgcaaggctgaaactcaaaggaattgacgggggcccgcacaagcggtggagtatgtggntttaattcgacgcaacgcgaagaaccttnccnanccttgacnttgattnctatgggtagagatnnccagttncttttnggaggacaagaaaacaggtggtgcacggctgtngtcanctngtgtngtgagatgttgggttaagtcccgcaacgagcgcaacccctattttttgttnccagcgagttaagtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaacctttgagccagcctc

SEQ ID NO: 353 - DNA, 1383 bp, Artificial Sequence
  Synthetic Polynucleotide
gacgaacgctggcggcgtgcttaacacatgcaagtcgaacggacagacagagagcttgctctcttgaagttagtggcgaacgggtgagtaacgcgtaatcaacctgcccttcagagggggataacaacgggaaaccgttgctaataccgcgtacgattcatagacggcatcgcttgtgaatgaaaggtggcctctatgtataagctatcgctgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaaaggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggcct

SEQ ID NO: 354 - DNA, 1509 bp, Artificial Sequence
  Synthetic Polynucleotide
ttagagtttgatcctggctcaggacgaacgctggcggcgtgcctaacacatgcaagtcgaacggagagatacgagagcttgctcttgtaaatcttagtggcaaacgggtgagtaacgcgtaaacaacctgcccaacggatggggacaacagacggaaacgactgctaatacccaatagactccggtttcgcatgaaaccgacaggaaaggtggcctctcgaagaagctaccgccgcaggaggggtttgcgtttgattagttagttggtggggtaacggcctaccaagacgatgatcaatagccggtctgagaggatgaacggccacactggaactgagacacggtccagactcctacgggaggcagcagtggggaatcttccgcaatggacgaaagtctgacggagcaacgccgcgtgagtgaagaaggccttcgggttgtaaagctctgttattcgggaagaacgattcgtttgtaaataatgaacggaagtgacggtaccgaaagagaaagccacggctaactacgtgccagcagccgcggtaatacgtaggtggcaagcgttgtccggaattattgggcgtaaagagcgcgtaggcggtatgataagtctgtcttagaagtgcggggcttaaccccgtgaggggacagagactgtcatactagagtctcggagaggaaagcggaattcctagtgtagcggtgaaatgcgtagagattaggaagaacaccggtggcgaaggcggctttctggacgagcactgacgctgaggcgcgaaagcgtggggagcgaacaggattagataccctggtagtccacgccgtaaacgatgggtactaggtgtaggaggtatcgaccccttctgtgccggagttaacgcaataagtaccccgcctggggagtacggtcgcaagattaaaactcaaaggaattgacgggggcccgcacaagcggtggagtatgtggtttaattcgacgcaacgcgaagaaccttaccaggtcttgacattgatcgctatccgcagagacgcggagttctccttcgggagacgagagaacaggtggtgcacggctgtcgtcagctcgtgtcgtgagatgttgggttaagtcccgcaacgagcgcaacccctatcttcaattaccagcacgacatggtggggactatggagagactgccgatgacaaatcggaggaaggcggggatgacgtcaagtcatcatgccccttatgacctgggctacacacgtactacaatggtcctgacagagagcagcgaagtggcgacaccaagcgaacctcagaaacaggatcccagttcggatcgcaggctgcaactcgcctgcgtgaagcaggaatcgctagtaatcgcgggtcagcataccgcggtgaatacgttcccgggccttgtacacaccgcccgtcacaccacgagagtggggaacacccgaagccggtgggagaaccgtaaggactcagccgtcgaaggtgggcttcatgattggggtgaa

SEQ ID NO: 355 - DNA, 1423 bp, Artificial Sequence
  Synthetic Polynucleotide
tcctggctcaaggcgaaacgccggcggcgtgcttaacacatgcaagttcgaaacgaaagagcgacggaagccttcgcctttcatcaatcttagcggcgaacgggtcgagtaacgcgtaatcaacctgcccttcagagggggacaacagttcggaaacgactgctaataccgcatacgattctaacctcggcatcgaggatggatgaaaggtggcctctatttataagctatcactgaaggaggggattgcgtctgattagctagttggaggggtaacggcccaccaaggcgatgattcagtagccggtctgagaggatgaacggccacattgggactgagacacggcccagactcctacgggaggcagcagtggggaatcttccgcaatggacgaaagtctgacggagcaacgccgcgtgagtgatgacggccttcgggtttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacgaatgggagttaatagacggaagcaataccgcgaggtggagcaaacccgagaaactctctctctgttcggaatcgtaggctgcgaactcgcctacgtgaagttcggaaatcgctagtaatcgcaggttcagcatactgcggtaaatacgttcccgggctttgtacacacc

SEQ ID NO: 356 - DNA, 1467 bp, Artificial Sequence
  Synthetic Polynucleotide
tcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggaggagaggcatctctcctgcgtgaaagatggcctctttttatgctatcacctgttgatgggtctgcgtctgattagctggtaggtgagataacggctcacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcgtgatgcgaacagtgtcatgcaatgacggtacctgtcgaggaagccacggctaactacgtgccagcagccgcggtaatacgtaggtggcgagcgttgtccggaatcattgggcgtaaagggagcgcaggcgggcaagtaagtctttcttaaaagtgcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagcgctagagatagctccctctcttcggagacaggaaaacaggtggtgcatggctgtcgtcagctcgtgtcgtgagatgttgggttaagtcccgcaacgagcgcaacccctgttcttgttgccatcaggtaaagctgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggcgcagccgtctaaggtggggaaggtgactggggtg

SEQ ID NO: 357 - DNA, 1493 bp, Artificial Sequence; identical to SEQ ID NO: 19
  Synthetic Polynucleotide

SEQ ID NO: 358 - DNA, 1410 bp, Artificial Sequence
  Synthetic Polynucleotide
agagtttgatcctggctcaggatgacctttagctacaggcttaacacatgcaagtcgaggggcagcatgtcggttgcttgcaaccgatgatggcgaccggcgcacgggtgagtaacgcgtatccaacctgcctcttaccagggaataacccgtcgaaaggcggactaatgccctatgccctccgcggcagacatctaatgtggaggaaagattcatcggtaagtgatggggatgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgatgaaggtcttaggatcgtaaagttctgttgttagggacgaagggtaagaatcataatacggtttttatttgacggtacctaacgaggaagccacggctaactacgtgccagcagccgcggtaatacgtaggcggcaagcgttgtccggaattattgggcgtaaagggagcgcaggcgggaaactaagcggatcttaaaagtgcggggctcaaccccgtgatggggtccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacgggattagataccccggtagtcctagccgtaaacgatggatactaggtgtgggaggtatcgactccttccgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagacttgacattgattgaaagacttagagataagtcccttctcttcggagaacaagaaaacaggtggtgcatggctgtcgtcggctcgtgtcgtgagatgttgggttaagtcccgcaacgagcgcaacccctatactatgttgccagcattacggatgggaactcatagtaggctgccgcggacaacgcggaggaaggcggggatgacgtcaagtcatcatgccccttacgtcttgggctacacacgtactacaatgggatgaacagagggaagcgaaatcgcgaggtggagcggatccctaaaagcatctctcagttcggattgtaggctgaaactcgcctacatgaagtcggaatcgctagtaatcgcaggtcagcatactgcggtgaatacgttcccgggccttgcactcaaagcccgtca

SEQ ID NO: 359 - DNA, 1475 bp, Artificial Sequence
  Synthetic Polynucleotide
acgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcaaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaagaagaacaccagtggcgaaggcgactttctggacgaaaactgacgctgaggcgcgaaagacaggggagcgaacgggattagataccccggtagtcctggccgtaaacgatgggtactaggtggaggaggtatcgaccccttctgtgcccgaagtaacgcaataagtaccccgcctggggaatacgaccgcaaggttgaaactcaaaggaattgacggggggcccgcccaagcggggaagtatgtggtttaattagtcgcaacgagaagaaccttaccaggtcttgacatgggatggatagaacaagagatagttcttttttttaggaagccagaaaacaggtggcgcacggttgtcgtcagttcgtgttgtgagaagttgggataagtcccgcaacgagcgcaacccctatcttatgttgccagcacttcgggtgggaaatcatgagagattgctgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatattgcggtgaatacgttcccgggctttgtacacaccgcccgtcacaccacgaaagtcggaagtgcccaaagccggtggggtaaccttcgggagccagccgtataaggcaaagtcga

SEQ ID NO: 360 - DNA, 1391 bp, Artificial Sequence
  Synthetic Polynucleotide
  misc_feature (10)..(11): n is a, c, g, or t
gagcgaatgnngcttgcttttatgagcttagtggcaaacgggtgagtaacacgtagacaacctgccgatcagatggggacaacattccgaaaggaatgctaataccgaatgaggtgtaagggaggcatctcccctacatgaaagatggcctctatatataagctatcactgatcaatgggtctgcgtctgattagctagtaggtaaggtaacggcttacctaggcgacgatcagtagccggtctgagaggatgaacggccacattgggactgagacacggcccagactcctacgggaggcagcagtagggaatcttccgcaatgggcgcaagcctgacggagcaacgccgcgtgagtgaagaaggtcttcggatcgtaaagctctgttgaaggggacgaacgtgcataacatgaataaggttatgtaatgacggtaccttttgaggaagccacggctaactacgtgccagcagccgcggtaatacgtaggtggcgagcgttgtccggaatcattgggcgtaaaggaagcgcaggcggtcatgtaagtcttacttaaaagttcggggctcaaccccgtgatgggtaagaaactatatgacttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaaagagctagagatagttccctctcttcggagacaggaaaacaggtggtgcatggctgtcgtcagctcgtgtcgtgagatgttgggctaagtcccgcaacgagcgcaacccctgttctttgttgccatcacgttatggtgggcactcaaaggagactgccgcggagaacgcggaggaaggcggggatgacgtcaagtcattatgcccttatggtctgggctacacacgtactacaatggagtggacagagagcagcaagagagcgatcttaagcgaacctcaaaaaccacttcccagttcggattgcaggctgcaacccgcctgcatgaagtcggaatcgctagtaatcgcaggtcagcatactgcggtgaatacgttcccgggtcttgtacacaccgcccgtcacaccacggaagtcgttcacacccgaagccggcag

SEQ ID NO: 361 - DNA, 1472 bp, Artificial Sequence
  Synthetic Polynucleotide
cggcgtgcttaacacatgcaagtcgaacgagagcgtagagaaatcttgctttttctacaatctagtggcaaacgggtgagtaacgcgtaaacaacctgccctacggatggggacaacagctggaaacggctgctaataccgaatacgttccgaaagtcgcatggctgtcggaagaaaggatggcctctatttataagctatcgccggaggaggggtttgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtgatttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattgg

SEQ ID NO: 362 - DNA, 1480 bp, Artificial Sequence
  Synthetic Polynucleotide
gaacgctggcggcgtgcttaacacctgcaagtcgaacgaaaagacggaaagagcttgctcttttcagaattgagtggcaaacgggtgagtaacacgtaaacaacctgccttcaggatggggacaacagacggaaacgactgctaataccgaataagttccaagggccgcatggcccatggaagaaaaggtggcctctacctgtaagctatcgcctgaagaggggtttgcgtctgattagctggttggaggggtaacgacccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagacaccctggtagtccacgccgtaaacgatggatactaggtgtaggaggtatcgaccccttctgtgccggagttaacgcaataagtatcccgcctgggaagtacgatcgcaagattaaactcaaaggaattgacgggggccccgcacaagggggggaagtattttggtttaatttgacgcaacggaaaagaaccttaccaggttcttgacattgatcgcgatttgcagaaatggggagttttttttcggaagacgagaaaacaggtggtgcacggctgtcgtcagctcgtgtcgtgagatgtggggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgagggagagcaaagctcaaaaacacacccccagttcagatcgcaggctgcaacccgcctgcgtgaagcaggaatcgctagtaatcgcgggtcagcataccgcggtgaatacgttcccgggccttgtacacaccgcccgtcacactatgagagtcagaaacacccgaagccggtgaagtaaccgcaaggagccagccgtcgaaggcggagctg

SEQ ID NO: 363 - DNA, 1423 bp, Artificial Sequence
  Synthetic Polynucleotide
agagtttgatcctggctcaggacgaacgctggcggcgtgcttaacacatgcaagtcgaacgaaaagacggaaagagcttgctctttccggaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctagttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaaccaggattagataccctggtagtccacgccgtaaacgatggatactaggtgtaggaggtatcgacccctcctgcgccggagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcccttgacgaacatagaaatatgttttctcttcggagcaaggagacaggtggtgcatggttgtcgtcagctcgtgtcgtgagatgttgggttaagtcccgcaacgagcgcaacccctatccccagtagccagcggttcggccgggcactctgaggagactgccagggataacctggaggaaggcggggatgacgtcaaatcatcatgccccttatgatttgggctacacacgtgctacaatggcgtaaacaaaggaaagcgagcctgcgaaggtaagcaaatcccaaaaataacgtcccagttcggactgcagtctgcaactcgactgcacgaagctggaatcgctagtaatcgcggatcagaatgccgcggtgaatacgttcccgggtcttgcacacaccgcccgtca

SEQ ID NO: 364 - DNA, 1357 bp, Artificial Sequence
  Synthetic Polynucleotide
atgggagcttgctcctatcatcttagtggcgaacgggtgagtaacgcgtaatcacctgcccttcaatgggggacaacagttggaaacgactgctaataccgcatacgtcggcatcgagaaaggtggcctttttaaagctatcgttgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaagagcctagtgtgaataatgctaggaagtgacggtaccggaatagaaagccacggctaactacgtgccagcagccgcggtaatacgtaggtggcaagcgttgtccggaattattgggcgtaaagcgcgcgcaggcggatctgccagtctgtcttaaaagttcggggcttaaccccgtgatgggatggaaactacagatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggatcgaccttctgtgccgcagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactaaggtgggaactcatgagagactgccgcagacaatgcggaggaaggcggggatgacgtcaaatcatcatgccccttatgacctgggctacacacgtactacaatgggctttataaagggaagcgaagtcgcgaggcggagcaaaccccagaaacaagctctcagttcggatcgtaggctgcaactcgcctacgtgaagtcggaatcgctagtaatcgcaggtcagatactgcggtgaatacgttcccgggccttgtacacaccgcccgtcacaccacgaaagtcggaagtgcccaaagccgg

SEQ ID NO: 365 - DNA, 1429 bp, Artificial Sequence
  Synthetic Polynucleotide
gagtttgatcatggctcaggacgaacgctggcggcgtgcttaacacatgcaagtcgaacggagcgaatgaaagcttgcttttatgcgcttagtggcaaacgggtgagtaacacgtagacaacctgccgacaggatggggacaacattccgaaaggaatgctaataccgaatgaagcggaggagaggcatctctcttccgtgaaagatggcctctatatataagctatcacctgtcgatgggtctgcgtctgattagctggtaggtgaggtaacggctcacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgtctaatgcgaatagttttaggtaatgacggtacccatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactatatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcagcgcgaagaaccttaccaggccttgacattgactgaaagtgctagagatagcatcctctcttcggagacaggaaaacaggtggtgcatggctgtcgtcagctcgtgtcgtgagatgttgggttaagtcccgcaacgagcgcaacccctgtcctttgttgccatcacgtaatggtgggcactcaaaggagactgccgcggagaacgcggaggaaggcggggatgacgtcaagtcatcatgccccttatggtctgggctacacacgtactacaatggaaacggacagagagcagcgaacccgcgagggcgaagcgaaacctcaaaaaaccgtttcccagttcggattgcaggctgcaacccgcctgcatgaaagtcggaaatcgctagtaatcgcaggtcagcaatactgcggtgaaatacgtttcccgggttcttgtactcaccgcccgtca

SEQ ID NO: 366 - DNA, 1465 bp, Artificial Sequence; identical to SEQ ID NO: 219
  Synthetic Polynucleotide

SEQ ID NO: 367 - DNA, 1421 bp, Artificial Sequence
  Synthetic Polynucleotide
agagtttgatcctggctcaggacgaacgctggcggcgtgcttaacacatgcaagtcgaacgagaagagaaggaagcttgcttctttcaaatctagtggcaaacgggtgagtaacacgtaaacaacctgccttcaggatggggacaacagacggaaacgactgctaataccgaatacgttccttaggtcgcatgatcttgggaagaaagggtggcctctacctgtaagctatcgcctgaagaggggtttgcgtctgattaggtagttggtgaggtaacggcccaccaagccgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtcggcagacgaataatctgctgaattgacggtacccgaatagcaagccacggctaactacgtgccagcagccgcggtaatacgtaggtggcaagcgttgtccggaattattgggcgtaaagcgcgcgcaggcggcttcttaagtccatcttaaaagtgcggggcttaaccccgtgatgggatggaaactgagaggctggagtatcggagaggaaagcggaattcctagtgtagcggtgaaatgcgtagatattaggaggaacaccagtggcgaaggcggcttactggacggcaactgacgttgaggctcgaaagcgtggggagcaaacaggattagataccctggtagtccacgccgtaaacgatgaatactaggtgtcggggagcaaagctcttcggtgccgccgcaaacgcaataagtattccacctggggagtacgttcgcaagaatgaaactcaaaggaattgacggggacccgcacaagcggtggagcacgtggtttaattcgaagcaacgcgaagaaccttaccaagccttgacatcccattgacagagcatgtaatgtgctttcccttcggggcagtggtgacaggtggtgcatggttgtcgtcagctcgtgtcgtgagatgttgggttaagtcccgcaacgagcgcaacccctatcttcagtagccagcggttcggccgggcactctggagagactgccagggataacctggaggaaggtggggatgacgtcaaatcatcgtgccccttatggcttgggctacacacgtgctacaatggcgtaaacaaagggaagcgagcctgcgagggggagcaaatcccaaaaataacgtctcagttcggattgtagtctgcaactcgactacatgaagctggaatcgctagtaatcgcgaatcagaatgtcgcggtgaatacgttcccgggtcttgcacacaccgcccgtca

SEQ ID NO: 368 - DNA, 1486 bp, Artificial Sequence
  Synthetic Polynucleotide
catggctcaggacgaacgctggcggcgtgcttaacacatgcaagtcgaacgagaagagaaggaagcttgcttctttcaaatctagtggcaaacgggtgagtaacacgtaaacaacctgccttcaggatggggacaacagacggaaacgactgctaataccgaatacattccttaggtcgcatgatcttgggaagaaagggtggcctctacctgtaagctatcgcctgaagaggggtttgcgtctgattaggtagttggtgaggtaacggcccaccaagccgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtcggcagacgaataatctgctgaattgacggtacccgaatagcaagccacggctaactacgtgccagcagccgcggtaatacgtaggtggcaagcgttgtccggaattattgggcgtaaagcgcgcgcaggcggcttcttaagtccatcttaaaagtgcggggcttaaccccgtgatgggatggaaactgagaggctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattgatcgctattccaagaaattggaagttcctcttcggaggacgagaaaacaggtggtgcacggctgtcgtcagctcgtgtcgtgagatgttgggttaagtcccgcaacgagcgcaacccctatcttatgttaccagcacgttatggtggggactcatgagagaccgccgcggacaacgcggaggaaggtggggatgacgtcaagtcatcatgccccttatgacctgggctacacacgtactacaatgggtgtcaacaaagagaagcgaagccgcgaggcagagcaaacctcaaaaacacacccccagttcagattgcaggctgcaactcgcctgcatgaagttggaattgctagtaatcgtggatcagcatgccacggtgaatacgttcccgggccttgtacacaccgcccgtcacaccatgagagttgggaacacccgaagtccgtagtctaaccgcaaggagggcgcggccgaaggtgggcct

SEQ ID NO: 369 - DNA, 1389 bp, Artificial Sequence
  Synthetic Polynucleotide
gacgaacgctggcggcgtgcttaacacatgcaagtcgaacggagagagatggaagcttgcttctatcgatcttagtggcgaacgggtgagtaacgcgtaaccaacctgcccttcagagggggataacaacgggaaaccgttgctaataccgcgtacgaatgaacttcggcatcgaagctcattgaaaggtggcctctatttataagctatcgctgaaggagggggttgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaatggtccttgtgtgaataatgcaaggatttgacggtaccggaatagaaagccacggctaactacgtgccagcagccgcggtaatacgtaggtggcaagcgttgtccggaattattgggcgtaaagcgcgcgcaggcggtttcataagtctgtcttaaaagtgcggggcttaaccccgtgaggggatggaaactatggaactggagtatcggagaggaaagcggaattcctagtgtagcggtgaaatgcgtagatattaggaagaacaccagtggcgaaggcggctttctggacgacaactgacgctgaggcgcgaaagccaggggagcgaacgggattagataccccggtagtcctggccgtaaacgaatggtattaggggtaggaggtattcgaccccccctgtcccgaagtaaacccaaaaagacccccccctggggggtacggtgccagggcggaaattcaaagaaaagacggggggcccgcacaaccgggggagtatgtgtttaatttgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggaggacatcaagtcatcatgccccctatgacctgggctacacacgtactacaatgggctttaatagagggaagcgaaaccgcgaggtggagcaaaccccagaaacaagctctcagttcggatcgtaggctgcaactcgcctacgtgaagtcggaatcgctagtaatcgcaggtcagcatactgcggtgaataagatcccgggccttgcac

SEQ ID NO: 370 - DNA, 1402 bp, Artificial Sequence
  Synthetic Polynucleotide
gacgaacgctggcggcgtgcttaacagatgcaagtcgaacggagagcgatggacgcttgcttctatcagtcttagtggagaacgggagaataacgcgtaatcaagctgcccttcagagggggacaacaggtggaaacgactgctaataccgcatacaatctagtctcggaatagaggatggatgagaggaggcctctatttccccgctatcactgaaggaggggattgcgtctgattagttagttggaggggtaacggcccaccaaggcgatgatcagtagccggtctgagaggatgaacggccacattgggactgagacacggcccagactcctacgggaggcagcagtggggaatcttccgcaatggtcgaaagtttgacggagcaacgctgcgtgagtgatgacggccttcgggttgtaaagctttgttaattgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtcttttttaaaagttcggggctataccccgtgatgggatggaaactgccaatttagagtattggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtacttcaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgcacacaccgcccgtca

SEQ ID NO: 371 - DNA, 1473 bp, Artificial Sequence
  Synthetic Polynucleotide
cggcgtgcttaacacatgcaagtcgaacggaaagagatgaaagagcttgctcttttattaatttcagtggcaaacgggtgagtaacacgtaaacaacctgccttaaggatggggataacagacggaaacgactgctaataccgaatacgttctaagcatcgcatggtgcatagaagaaagggtggcctctacaagaaagctatcgccttaagaggggtttgcgactgattaggtagttggtgaggtaacggctcaccaagccgacgatcagtagccggtctgagaggatgaacggccacactggaactgagacacggtccagactcctacgggaggcagcagtggggaatcttccgcaatggacgaaagtctgacggagcaacgccgcgtgaacgaagaaggtcttcggattgtaaagttctgtgattcgggacgaaagggtttgtggtgaataatcatagacattgacggtaccgaaaaagcaagccacggctaactacgtgccagcagccgcggtaatacgtaggtggcaagcgttgtccggaattattgggcgtaaagcgcgcgcaggcggtttcttaagtccatcttaaaggcgtggggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgcaatccatagaaatatggagttcttcttcggaagacgagaaaacaggtggtgcacggctgtcgtcagctcgtgtcgtgagatgttgggttaagtcccgcaacgagcgcaacccctatttcctgttaccagcacgtaaaggtggggactcaggagagaccgccgcggacaacgcggaggaaggcggggatgacgtcaagtcatcatgccccttatggcttgggctacacacgtactacaatgggtgccaacaaagagaagcgaaatcgcgagatggagcggacctcataaacgcacccccagttcagattgcaggctgcaactcgcctgcatgaagtaggaatcgctagtaatcgcgggtcagcataccgcggtgaatacgttcccgggccttgtacacaccgcccgtcacactatgggagtgggttgcaaaagaagtaggtagcttaaccttcgagagggcgcttaccactttgtgattcatga

SEQ ID NO: 372 - DNA, 1448 bp, Artificial Sequence; identical to SEQ ID NO: 120
  Synthetic Polynucleotide

SEQ ID NO: 373 - DNA, 1509 bp, Artificial Sequence; identical to SEQ ID NO: 274
  Synthetic Polynucleotide

SEQ ID NO: 374 - DNA, 1421 bp, Artificial Sequence
  Synthetic Polynucleotide
gagtttgatcatggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggaaagatgaaaggtggcctctatgtataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgaggggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggactggggtctgcaacccgaccccacgaagctggattcgctagtaatcgcgcatcagccatggcgcggtgaatacgttcccgggccttgcacacaccgcccgtc

SEQ ID NO: 375 - DNA, 1480 bp, Artificial Sequence
  Synthetic Polynucleotide
aacgctggcggcgtgcttaacacatgcaagtcgaacggagtttataggaagcttgcttcttgtaaacttagtggcgaacgggtgagtaacgcgtaaccaacctgcccttcagagggggataacaacgggaaaccgttgctaataccgcgtacgaatgaacttcggcatcggagctcattgaaaggtggcctctatttataagctatcgctgaaggagggggttgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaatggttcttgtgtgaataatgcaaggatttgacggtaccggaatagaaagccacggctaactacgtgccagcagccgcggtaatacgtaggtggcaagcgttgtccggaattattgggcgtaaagcgcgcgcaggcggtttcataagtctgtcttaaaagtgcggggcttaaccccgtgaggggatggaaactatggaactggagtatcggagaggaaagcggaattcctagtgtagcggtgaaatgcgtagatattaggaagaacaccagtggcgaaggcggctttctggacgacaactgacgctgaggcgcgaaagccaagggagcgaacgggattagataccccggtagtcctggccgtaaacgatgggtactaggtgtaggaggtatcgactccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaaaccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggt

SEQ ID NO: 376 - DNA, 1392 bp, Artificial Sequence
  Synthetic Polynucleotide
tggctcaggacgaacgctggcggcatgcctaacacatgcaagtcgaacggagattatttcggtaatcttagtggcgaacgggtgagtaacgcgtaggcaacctgccctttagttggggacaacatcccgaaaggggtgctaataccgaatgtgatcgctttctcgcatgagagagcgatgaaagatggcctctatttataagctatcgctaaaggatgggcctgcgtctgattagctagttggtggggtaacggctcaccaaggcgatgatcagtagccggtctgagaggatgaacggccacattgggactgagacacggcccagactcctacgggaggcagcagtggggaatcttccgcaatgggcgaaagcctgacggagcaatgccgcgtgagtgatgaaggaattcgttccgtaaagctcttttgtttatgacgaatgtgcagactgtgaataatggtttgtaatgacggtagtaaacgaaaaagcaacggctaactacgtgccagcagccgcggtaatacgtaggttgcaagcgttgtccggatttactgggtgtaaagggcgtgtaggcggagctgcaagtcagatgtgaaatcccggggctcaaccccggaactgcatttgaaactgtagcccttgagtatcggagaggcaagcggaattcctagtgtagcggtgaaatgcgtagatattaggaggaacaccagtggcgaaggcggcttgctggacgacaactgacgctgaggcgcgaaagcgtggggagcaaacaggattagataccctggtagtccacgctgtaaacgatgaatactaggtgtgggaggactgaccccttccgtgccgcagttaacacaataagtattccacctggggagtacgaccgcaagactgaaactcaaaggaattgacgggggcccgcacaagcagtggattatgtggtttaattcgacgcaacgcgaagaaccttaccaggatttgacatccaactaacgaagcagagatgcattaggtgcccttcggggaaagttgagacaggtggtgcatggttgtcgtcagctcgtgtcgtgagatgttgggttaagtcccgcaacgagcgcaacccctattgttagttgctacgcgagagcactctagcgagactgccgttgacaaaacggaggaaggcggggacgacgtcaaatcatcatgccccttatgtcctgggctacacacgtaatacaatggccgtcaacaaagggaagcgaagccgcgaggtggagcaaacccccaaaaacggtctcagttcggattgcaggctgcaactcgcctgcatgaagctggaattgctagtaatcgtggatcagcatgccacggtgaatacgttcccgggccttgtacacaccgcccgt

SEQ ID NO: 377 - DNA, 1428 bp, Artificial Sequence
  Synthetic Polynucleotide
gagtttgatcatggctcaggacgaacgctggcggcgtgcttaacacatgcaagtcgaacggaaacagatgaaagagcttgctcttttattaatttcactggcaaacgggtgagtaacacttaaacaacctgccttaaggatggggataacagacggaaacgactgctaatacccaatacgttctaagcatcacatgatgcatagaagaaagggtggcctctacaagaaagctatcgccttaagaggggtttgcgactgattaggtagttggtgaggtaacggctcaccaagccgacgatcagtagccggtctgagaggatgaacggccacactggaactgagacacgatccaaactcctacgggaggcagcagtggggaatcttccgcaatggacgaaagtctgacagagcaacgccgcgtgaacgaagaaggtcttcggattgtaaagttctgtgattcgggacgaaagggtttgtggtgaataatcatagacattgacggtacctaaaaagcaagccacggctaactacgtgccagcagccgcggtaatacataggtggcaagcgttgtccggaattattgggcgtaaagcgcgcgcaagcagtttcgtaagtccatcttaaaagcgtgcggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaggcgcgaaagcgtggggagctaacaggattagatacactggtagtccacgccgtaaacgatggatagtaggtgtaggaggtatcgacccctcctgtgccggagttaacgcaataagtatcccgcctgggaagtacgatcgcaagattataactcaaaggaatttacgggggcccgcacaagcggtggagtatgtggtttaattagacgcaacgtgaagaaccttaccaagccttgacattgatagcaatccatagaaatatggagttcttcttcggaagatgagaaaacaggtggtgcacggctgttgtcacctcgtgtcgtgagatgttgggttaagtcccgcaacgagcgcaacccctatttcctgttaccagcacgtaaaggtggggactcaggagagaccgccgcggacaacgcggaggaaggcggggatgacgtcaagtcatcatgccctttatggcttgggctacacacgtactacaatgggtgccaacaaagagaagcgaaatcgcgagatggagcggacttcataaacgcacccccagttcagattgcaggctgcaactcgcctgcatgaagtaggaatcgttagtaatcgcgggtcagcataccgcggtgaatacgttcccgggccttgtacacaccgcccgtc

SEQ ID NO: 378 - DNA, 1414 bp, Artificial Sequence
  Synthetic Polynucleotide
agagtttgatcatggctcaaggacgaacgctggcggcgtgcttaacaacatgcaagtcgaacgagaagagatgagaagcttgcttcttattgattcgagtggcaaacgggtgagtaacgcgtaagcaacctgccctctagatggggacaacagctggaaacggctgctaataccgaatacgttctttctgtcgcatggcagaaggaagaaagggaggctcttcggagctttcgctggaggaggggcttgcgtctgattagctagttggaggggtaacggcccaccaaggcgacgatcagtagccggtctgagaggatgaacgccacatggacacctgagacacggcccagactcctacgggaggcagcagtggggaatcttccgcaatggacgaaagtctgacggagcaacgccgcgtgaacgatgacggccttcgggttgtaaagttctgttatacgggacgaatggtacgacggtcaatacccgtcgtaagtgacggtaccgtaagagaaagccacggctaactacggtgccagcagccgcgcgtaatacgtaggtggcaagcgttgtcggattattgggcgtaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgtggatactggtgtaggaggtatcgaccccttctgtgccggagttaacgcaataagtatcccgcctggggagtacggccgcaaggctgaaactcaaaaggaattgacgggggcccgcacaagcggtggagtatgtggtttaattcgacgcaacgcgaagaaccttaccaagccttgacattgattgctaagggtagagataccctgttcctcttcggaggacaagaaaacaggtggtgcacggctgtcgtcagctcgtgtcgtgagatgttgggttaagtcccgcaacgagcgcaacccctatcttctgttaccagcgggttaagtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaacccgcctgcatgaagcaggaatcgctagtaatcgcaggtcagcaaaatacggtgaatacgttcccgggccttgtacaca

SEQ ID NO: 379 - DNA, 1424 bp, Artificial Sequence
  Synthetic Polynucleotide
agagtttgatcctggctcaggacgaacgctggcggcgtgcttaacacatgcaagtcgaacggagagcgatggaagcttgcttctatcaatcttagtggcgaacgggtgagtaacgcgtaaccaacctgcccttcagagggggataacaacgggaaaccgttgctaataccgcgtacgattaagcttcggcatcgaagcttaatgaaaggtggcctctatgtataagctatcgctgaaggagggggttgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaatggtctttgtgtgaacaatgcaaagatttgacggtaccggaatagaaagccacggctaactacgtgccagcagccgcggtaatacgtaggtggcaagcgttgtccggaattattgggcgtaaagcgcgcgcaggcggttttgtaagtctgtcttaaaagttcggggctcaaccccgtgatgggatggaaactatgaaactagagtatcggagaggaaagcggaattcctagtgtagcggtgaaatgcgtagatattaggaagaacaccagtggcgaaggcggctttctggacgacaactgacgctgaggcgcgaaagccaggggagcgaacgggattagataccccggtagtcctggccgtaaacgatgggtactaggtgtaggaggtatcgaccccttatgtccaggatttacgcaataagtaccaagctcggggagtacggtagcaaggctgatatcaaaggaatatgacgggggcccgcacaagcggtggagggtgtggtttaatttgtcgcagagcggaaaaccctttcccggtcgttgacatagtatggacgaaacaagagattgtttttctctttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggacgcgaagccgcgaggtggagcaaaccccagaaacaagctctcagttcggatcgtaggctgcaactcgcctacgtgaagtcggaatcgctagtaatcgcaggtcagcatactgcggtgaatacgttccagggccttgcacacaccgcccgtca

SEQ ID NO: 380 - DNA, 1515 bp, Artificial Sequence
  Synthetic Polynucleotide
gctcaggacgaacgctggcggcgtgcttaacacatgcaagtcgaacgagagacggtgaaaagcttgcttttaatcgaatcgagtggcaaacgggtgagtaacgcgtaaacaacctgcccctgggatggggacaacagctggaaacggctgctaataccgaatgagctccacgtgccgcatggcaggaggaggaaagggtggcctctggaacaagctaccgccgagggaggggtttgcgtctgattagctggttggtgaggtaagggctcaccaaggcgacgatcagtagccggtctgagaggatgaacggccacattggaactgagagacggtccagactcctacgggaggcagcagtggggaatcttccgcaatgggcgaaagcctgacggagcaacgccgcgtgagtgaagacggccttcgggttgtaaagctctgttacacgggacgaacgggttttgtgcgaacagcataagaccgtgacggtaccgtagaagaaagccacggctaactacgtgccagcagccgcggtaatacgtaggtggcaagcgttgtccggaatgattgggcgtatagggcgcgcaggcggccggccaagtctgtctaaaaagtgcggggcttaaccccgtgaggggagagaaactggccggctgagagtgtcggagaggaaagcggaattcctagtgtagcggtgaaatgcgtagatattaggaggaacaccggtggcgaaagcggctctctggacgacaactgacgctgaggcgcgaaagccaggggagcaaacgggattagataccccggtagtcctggccgtaaacgatgggtactaggtgtgggaggtatcgaccccttccgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgagtgaagggcgtagagatacgccgttcttcttcggaagacacgaaaacaggtggtgcacggctgtcgtcagctcgtgtcgtgagatgttgggttaagtcccgcaacgagcgcaacccttatcttcagttaccagcacgtagaggtggggactcaggagagactgccgcagacaatgccgaggaaggcggggatgacgtcaagtcatcatgcccctaatggcttgggctacacacgtactacaatggctctcaatagagggaagcaagggagcgatccggagcaaaccccaaaaacagagtcccagttcggattgcaggctgcaactcgcctgcatgaaggaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtaac

SEQ ID NO: 381 - DNA, 1414 bp, Artificial Sequence
  Synthetic Polynucleotide
gagtttgatcatggctcaggacgaacgctggcggcgtgcttaacacatgcaagtcgaacgaagagcgacggaagcttgcttctatcaatcttagtggcgaacgggtgagcaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacacagtggcgaaggcgactttctggacgaaactgacgctgaggcgcgaagccaggggagcgaacgggattagatacccggtagtcctggcgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaaccggtggtgccccgttgttgtccggttgggttggggggaggtggggtaaggcccgccaccgggcccaccccctttcttaggtgcccaccacttgggggggggactcaggagagactcccgcggccaatgcggaggaaggcggggaggacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggcccttgtacacaccgccc

SEQ ID NO: 382 - DNA, 1387 bp, Artificial Sequence
  Synthetic Polynucleotide
gacgaacgctggcggcgtgcttaacacatgcaagtcgaacgaaaagagggaaagagcttgctctttccggaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggcctcactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtaccggagaggaaagtggaattcctagtgtagcggtgaaatgcgtagagattaggaagaacaccggtggcgaaggcgactttctggacgaaaactgacgctgaggcgcgaaagcgtggggagcaaacaggattggataccccggtagtcctggccgtaaacgatggatactaggtgtgggaggtatcgacccctaccgtgccagagttaacgcaataagtatcccgcctggggagtacggccgcaaggctgaaactcaaaggaattgacggtgacccgcacaagcggtggagtatgtggtttaattcgaagcaacgcgaagaaccttaccaggccttgacattgactgaaagagctagagatagctccctctcttcggagacaggaaaacaggtggtgcatggctgtcgtcagctcgtgtcgtgagatgttgggttaagtcccgcaacgagcgcaacccctgttctttgttgccagcatgtaaggatgggcactcaaaggagactgccgcggagaacgcggaggaaggcggggatgacgtcaagtcatcatgccccttatggtctgggctacacacgtactacaatgggacggacagagggcagcgagagagtgatcttaagcgaatctcaaaaaccgtttctcagttcggattgcaggctgcaactcgcctgcatgaagtcggaatcgctagtaatcgcaggtcagcatactgcggtgaatacgttcccgggtct

SEQ ID NO: 383 - DNA, 1414 bp, Artificial Sequence
  Synthetic Polynucleotide
gagtttgatcatggctcaggacgaacgctggcggcgtgcttaacacatgcaagtcgaacgggaacctttatttcggtaaaggtgagagtggcaaacgggtgagtaacacgtaggcaacctgccgacaggatggggacaacattccgaaaggaatgctaataccgaatgaagtcaccggagggcatcctctggtgatgaaagatggcctctgaatatgctatcacctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgcacgggacgaaaaccgagcttgaaaacattgagtttgggtgacggtaccgagcgaggaagccacggctaactacgtgccagcagccgcggtaatacgtaggtggcgagcgttgtccggaattattgggcgtaaagggagcgcaggcggacatataagtccatcttaaaagtgcggggctcaaccccgtgaggggatggaaactgtatgccttgagtgcaggagaggaaagcggaattcccagtgtagcggtgaaatgcgtagatattgggaggaacaccagtggcgaaggcggctttctggactgtaactgacgctgatgctcgaaagccaggggagcgaacgggattagataccccggtagtcctggccgtaaacgatgaatgctagctgtaggatgtatagacccctcgtgtgctgtagttaccgcaataagcattccgcatggggagtacggtcgcaggactggaactgaaaggaattgatgggggcccgcacaagggctggagtatgtggtataattcgacgttacgcgttagaaccttaccagggcttgacattgcgtgaaagtgatagagatagctacctccctttggggacatgaaaacaggtagagcatggctgtcgtcagcttgtgtcgtgagatgttgggttaagtcccgcaaccagtgcaacccctgtcctttgttgccagcgcgtaatggcgggaactcaaaggagactgccgcggagaacgcggaggaaggcggggatgaggtcaagtcatcatcccccttatctcctgggctacacacgtacatacaatgggatggacagagggaagcgaaggcgcgagccggagcggaccccacaaaccatcccccagttcggattgcaggctgcaacccgcctgcatgaagtcggaatcgctagtaatcgcaggtcagcatactgcggtgaatacgttcccgggccttgtacacaccgcccgtc

SEQ ID NO: 384 - DNA, 1479 bp, Artificial Sequence
  Synthetic Polynucleotide
gacgaacgctggcggcgtgcttaacacatgcaagtcgagcggggtgtttatttcggtaaacaccaagtggcgaacgggtgagtaacgcgtaagcaatctaccttcaagatggggacaacacttcgaaaggggtgctaataccgaatgaatgagagatgaccgcatggatatttctctaaaggaggcctctgaaaatgcttccgcttgaagatgagcttgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggtcttcggattgtaaagctctgttgtacatgacgaatgtgccggttgtgaataatggttggtaatgacggtagtgtacgaggaagccacggctaactacgtgccagcagccgcggtaatacgtaggtggcaagcgttgtccggaattattgggcgtaaagagcatgtaggcggcctattaagtcgggcgtgaaaatgcggggctcaaccccgtatggcgcccgatactggtgggcttgagtgcaggagaggaaaggggaattcccagtgtagcggtgaaatgcgtagatattgggaggaacaccagtggcgaaggcgcctttctggactgtgtctgacgctgagatgcgaaagccaggggagcgaacgggattagataccccggtagtcctagccgtaaacgatggatactaggtgtgggaggtatcgaccccttccgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagacttgacatcgactgacgtacttagagataagtatttttacttcggtaaacaggaagacaggtggtgcatggctgtcgtcagctcgtgtcgtgagatgttgggttaagtcccgcaacgagcgcaacccctatactatgttgccagcacgtaaaggtgggaactcatagtagactgccgcggacaacgcggaggaaggcggggatgacgtcaagtcatcatgccccttacgtcttgggctacacacgtactacaatgggatgaacagagggaagcgaagtcgcgaggcagagcggaaccctaaaagcatctctcagttcggattgcaggctgaaactcgcctgcatgaagtcggaatcgctagtaatcgcaggtcagcatactgcggtgaatacgttcccgggccttgtacacaccgcccgtcacaccacgaaagtcattcacacccaaagccggctaagggccgaaaggaaccgaccgtcgagggtgggggcgatgattggggtga

SEQ ID NO: 385 - DNA, 1427 bp, Artificial Sequence
  Synthetic Polynucleotide
agagtttgatcctggctcaggacgaacgctggcggcgtgcttaacacatgcaagtcgaacgaaaagacggaaagagcttgctcttttcagaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgcacacaccgcccgtca

SEQ ID NO: 386 - DNA, 1399 bp, Artificial Sequence
  Synthetic Polynucleotide
gagtttgatcctggctcaggacgaacgctggcggcgtgcctaacacatgcaagtcgaacggagaattttatttcggtaggattcttagtggcgaacgggtgagtaacgcgtaggcaacctgccctttagacgggacaacattccgaaaggagtgctaataccggatgagatcattttcccgcataggagagtgaagaaagatggcctctacatgtaagctatcgctaaaggatgggcctgcgtctgattagctagttggtagtgtaacggactaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggatttcggtctgtaaaactctgttgtttatgacgaacgtgcagtgtgtgaacaatgcattgcaatgacggtagtaaacgaggaagccacggctaactacgtgccagcagccgcggtaatacgtaggtggcgagcgtcgtccggaattattgggcgtaaagagcatgtaggcggcctattaagtcgagcgtgaaaatgcggggctcaaccccgtatggcgctggaaactggtaggcttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaaggcttgacattgattgatcgctctagagatagagctttcccttcggggacaagaaaacaggtggtgcatggctgtcgtcagctcgtgtcgtgagatgttgggttaagtcccgcaacgagcgcaacccctatcctatgttaccagcaagtgaagttggggactcatgggagactgccagggacaacctggaggaaggcggggatgacgtcaagtcatcatgccccttatgtcttgggctacacacgtactacaatggtcggaaacagagggaagcaaagccgcgaggcagagcaaaccccagaaacccgatctcagttcggatcgcaggctgcaactcgcctgcgtgaagtcggaatcgctagtaatcgcaggtcagcatactgcggtgaatacgttcccgggccttg

SEQ ID NO: 387 - DNA, 1486 bp, Artificial Sequence
  Synthetic Polynucleotide
gacgaacgctggcggcgtgcttaacacatgcaagtcgaacgaggcttcagaagcttgcttttgaagccgagtggcaaacgggtgagtaacgcgtaaacaacctgccttcaggatggggacaacagacggaaacgactgctaataccgaataccttccggagaccgcatgatttccggaagaaagggtggcctctacttgtaagctatcgcctgaagaggggtttgcgtctgattaggcagttggcgaggtaacggcccaccaaaccgacgatcagtagccggtctgagaggatgaacggccacactggaactgagacacggtccagactcctacgggaggcagcagtggggaatcttccgcaatggacgaaagtctgacggagcaacgccgcgtgagtgatgacggccttcgggttgtaaagctctttgatccgggacgaatggtccttgtgcgaataccacagggaagtgacggtaccggaagaacaagccacggctaactacgtgccagcagccgcggtaatacgcaggtggcaagcgttgtccggaattattgggcgtaaagcgcgcgcaggcggccctttaagtccatcttaaaagcgtggggcttaaccccatgatgggatggaaactggagagctggagtatcggagaggaaagcggaattcctagtgtagcggtgaaatgcgtagagattaggaagaacaccggtggcgaaggcggctttctggacgacaactgacgctgaggcgcgaaagcgtggggagcaaacaggattagataccctggtagtccacgccgtaaacgatggatactaggtgtaggaggtatcgaccccttctgtgccggagctaacacaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgcaatctcaagaaattgagagttctccttcgggagacgagaaaacaggtggtgcacggctgtcgtcagctcgtgtcgtgagatgttgggttaagtcccgcaacgagcgcaacccttattttctgttgccagcacgtaaaggtggggactcaggaaagactgccgcagacaatgcggaggaaggcggggatgacgtcaagtcatcatgccccttatggcttgggctacacacgtactacaatgggcgtcaacaaagagaagcgaaagggcgacctggagcagacctcaaaaacacgcccccagttcagatcgcaggctgcaacccgcctgcgtgaagcaggaatcgctagtaatcgcgggtcagcataccgcggtgaatacgttcccgggccttgtacacaccgcccgtcacactatgagagttggaaacgcccgaagccggtggggtaaccgaaaggagccagccgtctaaggtggagccgatgattggagtga

SEQ ID NO: 388 - DNA, 1423 bp, Artificial Sequence
  Synthetic Polynucleotide
agagtttgatcctggctcaggacgaacgctggcggcgtgcttaacacatgcaagtcgaacgaaaagacggaaagagcttgctctttccagaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcaattcggatgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgcacacaccgcccgtca

SEQ ID NO: 389 - DNA, 1400 bp, Artificial Sequence
  Synthetic Polynucleotide
tagtggcgaacgggtgagtaacgcgtaatcaacctgcccttcagagggggacaacagttggaaacgactgctaataccgcatacgatctaatctcggcatcgaggatatatgaaaggtggactctacatgtaagctatcactgaaggaggggattgcgtctgattagctagttggaggggtaacggcccaccaaggcgatgatcagtagccggtctgagaggatgaaccgccacattgggactgagacacggcccagactcctacgggaggcagcagtggggaatcttccgcaatggacgaaagtctgacggagcaacgccgcgtgagcgatgacggccttcgggttgaaaagctctgttaatcgggacgaaaggccttcttgcgaatagtgagaaggattgacggtaccggaatagaaagccacggctaactacgtgccagcagccgcggtaatacgtatgtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagcgtagcggtgaaatgcgttagatattaggaagaacaccagtggcgaaggcgacttttctggacgaaaactgacgctgaggcgcgaaagccaggggagcgaatgggattagaataccccggtaatcctggccgcaaaccatgggtactaggtgtaggaggtatcgaccccttctgtgccggagttaaggcaataagtagcccgcctgggggagtggggccgcaagggtgaaactcaaaggaattgacgggggcgcgcacaagcggtggagtatgtggtttaattcgacgctacgcgaagaaccttaacaggtcttgacattgatggacagaaccagagatggttccttttcttcggatgccagaaaacaggtggtgcacggttgtcgtcagctcgtgtcgtgagatgttgggttaagtcccgcaacgagcgcaacccctatcttatgttgccagcacgtaaaggtgggaactcatgagagactcccgcagacaatccggaggaaggcggggatgatgtcaaatcatcatgccccttatgtcctggcatacacacgtattacaatgggagttaagagccggaagcgagatcgcgagatggagcaaacccgagacacactctctcagttcggatcgtaggctgcaactcgcctacgggaagtcggaatcgctagtaatctcaggtcagcatactgcggtgaatacgttcccgggccttgtacacaccgcccgtcactccacgaaagtcggaagtgcccaaaaaaaggggggtaaccttcgggagccagccgtctaaggtg

SEQ ID NO: 390 - DNA, 1511 bp, Artificial Sequence
  Synthetic Polynucleotide
  misc_feature (104)..(104): n is a, c, g, or t
  misc_feature (177)..(177): n is a, c, g, or t
  misc_feature (252)..(252): n is a, c, g, or t
  misc_feature (581)..(581): n is a, c, g, or t
  misc_feature (1082)..(1082): n is a, c, g, or t
  misc_feature (1100)..(1100): n is a, c, g, or t
  misc_feature (1117)..(1117): n is a, c, g, or t
  misc_feature (1124)..(1124): n is a, c, g, or t
  misc_feature (1223)..(1223): n is a, c, g, or t
  misc_feature (1262)..(1262): n is a, c, g, or t
  misc_feature (1371)..(1371): n is a, c, g, or t
cgaacgctggcggcgtgcttaacacatgcaagtcgaacgagacgattgaaagcttgcttttgaaagtcgagtgccaaacgggtgagtaacgcgtagacaacctnccgtaaacatggggacaacagtccgaaaggactgctaataccgaatgttgtggaacttccgcatgggagctcnactaaagatggcctctacttgtaagctatcgctttacgatgggtctgcgtctgattagctagttggtggggtaanggcttaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtggagatggtgaataaccatttccaatgacggtacctgacgaggaagccacggctaactacgtgccagcagccgcggtaatacgtaggtggcgagcgttgtccggaattattgggcgtaaagggagcgcaggcgggagntcaagtctatcttaaaagtgcggggctcaaccccgtgaggggatggaaactggtcttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaagagctagagatagctccctctcttcggagacacgaaaacaggtggtgcatggctgtcgtcagctcgtgtcgtgagatgttgggttangtcccgcaacgagcgcancccctatcctttgttgncagcacntaatggtgggaactcaaaggagactgccgcggacaacgcggaggaaggcggggatgacgtcaagtcatcatgccccttatgtcctgggctacacacgtnctacaatgggatggacagagagcagcgaagccgcgaggncaagcgaaccccataaaccatctcccagttcggattgcaggctgcaacccgcctgcatgaagttggaatcgctagtaatcgcaggtcagcatactgcggtgaatacgtncccgggccttgtacacaccgcccgtcacaccacggaagtcattcacacccgaagccggcaggctaaccgcaaggaggcagccgtctaaggtgggggcgatgactggggtgaagtcgtaacaaggtagccgtatcggaagg

SEQ ID NO: 391 - DNA, 1475 bp, Artificial Sequence
  Synthetic Polynucleotide
tggctcaggacgaacgctggcggcgtgcttaacacatgcaagtcgaacggagaattatttcggtaattcttagtggcgaacgggtgagtaacgcgtagacaacctaccttttagatggggacaacatcgcgaaagcggtgctaataccgaatgttgataatgaaatgcatgtttcgttatttaaagatggcctctatatataagctatcgctaaaagatgggtctgcgtctgattagctagttggtgagataacagcccaccaaggcaacgatcagtagccggtctgagaggatgaacggccacattgggactgagacacggcccaaactcctacgggaggcagcagtggggaatcttccgcaatggacgaaagtctgacggagcaacgccgcgtgagtgaagaaggttttaggatcgtaaagctctgttgtttaggacgaatgtgccttatgcgaatagtatgaggtaatgacggtactaaacgagaaagccacggctaactacgtgccagcagccgcggtaatacgtaggtggcaagcgttgtccggaattattgggcgtaaagggagcgcaggtgggaaaataagtctgttttaaaagtgcggggctcaaccccgtgatggaatggaaactgtttttcttgagtgcaggagaggaaagtggaattcctagtgtagcggtgaaatgcgtagatattaggaggaacaccagtggcgaaggcgactttctggactgtaactgacactgaggctcgaaagccagggtagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccagggcttgacattgattgaaagacgtagaggtacgtacctcttcttcggaagacaagaaaacaggtggtgcatggctgtcgtcagctcgtgtcgtgagatgttgggttaagtcccgcaacgagcgcaacccctatcatttgttgccagcacgtaaaggtgggaactcaaatgagactgccgcggataacgcggaggaaggcggggatgacgtcaagtcatcatgccccttatgtcctgggctacacacgtactacaatgggattgacagagggaagcaaagccgtgaggccgagcaaatctcaaaaataacgtctcagttcggactgtagcctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgat

SEQ ID NO: 392 - DNA, 1401 bp, Artificial Sequence
  Synthetic Polynucleotide
tcgagtggcaaacgggtgagtaacgcgtaaacaacctgccccgcagatggggacaacagctggaaacggctgctaataccgaatacggtcctcttagcgcatggtaagaggaagaaagggtggcctctggaacaagctaccgctgtgggaggggtttgcgtctgattagctggttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttataggggacgaacggccgggtagcgaagaggtagccggcatgacggtaccgtaagagaaagccacggctaactacgtgccagcagccgcggtaatacgtaggtggcaagcgttgtccggaatgattgggcgtaaagggcgcgcaggcggctgtgtaagtctgtctaaaaagtgcggggctaaaccccgtgagaggatggaaactggacagctgagagtgtcggagaggaaagcggaattcctagtgtagcggtgaaatgcgtagatattaggaggaacaccggtggcgaaagcggctttctggacgacaactgacgctgaggcgcgaaagccaggggagcaaacgggattagataccccggtagtcctggccgtaaacgatgggtactaggtgtaggaggtatcgacccctcctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgctcgcaacgggtagagatacctggttcttcttcggaagacgagacaacaggtggtgcacggctgtcgtcagctcgtgtcgtgagatgttgggttaagtcccgcaacgagcgcaacccctatcttcagttaccagcacgtagcggtggggactcaggagagacagccgcagacaatgcggaggaaggcggggacgacgtcaagtcatcatgccccttatggcttgggctacacacgtactacaatggctctaaatagagggaagcgaaggagcgatccggagcaaaccccgcaaacagagtcccagttcggattgcaggctgcaactcgcctgcatgaaggaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcaaaggtg

SEQ ID NO: 393 - DNA, 1487 bp, Artificial Sequence; identical to SEQ ID NO: 247
  Synthetic Polynucleotide

SEQ ID NO: 394 - DNA, 1363 bp, Artificial Sequence
  Synthetic Polynucleotide
ggacgaacgctggcagcgtgcttaacacatgcaagtcgaacgaaagaaaagcttgctttttttgagtggcaaacgggtgagtaacacgtaaacaacctgccttcaggatggggacaacagacggaaacgactgctaataccgaatacgttccaagcgcatgcttatggaagaaaggtggtaatatcgcctgaagaggggtttgcgtctgattaggcagttggcggggtaacggcccaccaaaccgacgatcagtagccggtctgagaggatgaacggccacactggaactgagacacggtccagactcctacgggaggcagcagtggggaatcttccgcaatgggcgaaagcctgacggagcaacgccgcgtgagtgaagacggccttcgggttgtaaagctctgtgatccgggacgaaagagcgccatgaagatggcgaagtgacggtaccgtagaagaaagccacggctaactacgtgccagcagccgcggtaatacgtaggtggcaagcgttgtccggaattattgggcgtaaagggcgcgcaggcggcctcttaagtccatcttaaaagagcggggcttaaccccgttatgggatggaaactgagaagctggagtatcggagaggaaagtggaatttctagtgtagcggtgaaatgcgtagagattaggaagaacaccggtggcgaaggcgactttctggacgaaactgacgctgaggcgcgaaagcgtggggagcaaacaggattagataccctggtagtccacgccgtaaacgatggatactaggtgtaggaggtatcgacccttccgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgagtgaagggcgtagagatacgccgttctcttcggagacacgaaaacaggtggtgcacggctgtcgtcagctcgtgtcgtgagatgttgggttaagtcccgcaacgagcgcaacccctatcatttgttgccagcacgtaaaggtggggactcaaatgagaccgccgcggacaacgcggaggaaggtggggacgacgtcaagtcatcatgccccttatgacctgggctacacacgtactacaatgggtgtacaaagagaagcgaagccgcgaggcggagccaaccccaaaaaacacccccagttcggattgcaggctgcaacccgcctgcgtgaagtaggaatcgctagtaatcgcgggtcagcataccgcggtgaatacgttcccgggccttgcacacaccgcc

SEQ ID NO: 395 - DNA, 1407 bp, Artificial Sequence; identical to SEQ ID NO: 127
  Synthetic Polynucleotide

SEQ ID NO: 396 - DNA, 1424 bp, Artificial Sequence
  Synthetic Polynucleotide
ggctcagggcgaacgcccggcggcgtgcttcacacacgcaagttcgaaacgaagagcgaacggaagcctcgctttcatcaattcttagcggcgagacgggcgagtaacgcgtaatcaacccgccctttcagagggggaacaacagttggaaacgagctgctaataccgcatacgattctaatctcggcatcgaggatggatgaaaggtggcctctacatgtaagctatcactgaaggaggggattgcgtctgattagctagttggaggggtaacggcccaccaaggcgatgattcagtagccggtctgagaggatgaacggccacattgggactgagacacggcccagactcctacgggaggcagcagtggggaatcttccgcaatggacgaaagtctgacggaacaacgccgcgtgagtgatgacggccttcgggtttgtaaagctctgttaatcgggacgaaaggccttcttgcgaatagtgagaaggattgacggtaccggaatagaaagccacggctaactacgtgccagcggccgcggtaatacgtaggtggcaagcgttgtccggaattattgggcgtaaagcgcgcgcaggcggatcggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggcgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaaactcgcctacgtgaagtcggaatcgctagcaatcgcaggtcagcatactgcggtgaatacgttcccgggccctttgtacacaccgcccgt

SEQ ID NO: 397 - DNA, 1416 bp, Artificial Sequence
  Synthetic Polynucleotide
gagtttgatcatggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggacagatgaaaggtggcctctacatgtaagctatcactgaaggaggggattgcgtctgatcagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttaaaactcaaaaggaattgacgggggcccgcacaagcggtggagtatgtggtttaattcgacgcaacgcgaagaaccttaccaggtcttgacattgatggacagaaccagagatggttcttcttcttcggaagccagaaaaacaggtggtgcacggttgtcgtcagctcgtgtcgtgagatgttgggttaaagtcccgcaacgagcgcaacccctatcttatgttgccagcacgtaaaaggtggaaactcatgagagactgccgcagacaatgcggaggaaggcggggatgaacgtcgaaatcatcgatgccccttatgaacctgggctacgcgcgtactacgaatggaagttaatagacggaaagcgagatcgcgagatgaagcaacccgaagaaaccactctctcggttcggattcgtaggctgcaactcgcctacgtaaagtcgaaatcgctaggattcgcgggtcagctgactgcggtggatacgttcccgggcc

SEQ ID NO: 398 - DNA, 1400 bp, Artificial Sequence; identical to SEQ ID NO: 38
  Synthetic Polynucleotide

SEQ ID NO: 399 - DNA, 1428 bp, Artificial Sequence
  Synthetic Polynucleotide
agagtttgatcctggctcaggacgaacgctggcggcgtgcgtaacacatgcaagtcgaacgagagagtgagagaagcttgcttttcttacgatcgagtggcaaacgggtgagtaacgcgtaaacaacctgccccgcagatggggacaacagctggaaacggctgctaataccgaatacggtcctcttagcgcatggtaagaggaagaaagggtggcctctggaacaagctaccgctgtgggaggggtttgcgtctgattagctggttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttataggggacgaacggccgggtagcgaagaggtagccggcatgacggtaccgtaagagaaagccacggctaactacgtgccagcagccgcggtaatacgtaggtggcaagcgttgtccggaatgattgggcgtaaagggcgcgcaggcggctgtgtaagtctgtctagaaagtgcggggctaaaccccgtgagaggatggaaactggacagctgagagtgtcggagaggaaagcggaattcctagtgtagcggtgaaatgcgtagatattaggaggaacaccggtggcgaaagcggctttctggacgacaactgacgctgaggcgcgaaagccaggggagcaaacgggattagataccccggtagtcctggccgtaaacgatgggtactaggtgtaggaggtatcgacccctcctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgctcgcaacgggtagagatacctggttcttcttcggaagacgagacaacaggtggtgcacggctgtcgtcagctcgtgtcgtgagatgttgggttaagtcccgcaacgagcgcaacccctatcttcagttaccagcacgtagaggtggggactcaggagagactgccgcagacaatgcggaggaaggcggggacgacgtcaagtcatcatgccccttatggcttgggctacacacgtactacaatggctctaaatagagggaggcgaaggagcgatccggagcaaaccccgcaaacagagtcccagttcggattgcaggctgcaactcgcctgcatgaaggaggaatcgctagtaatcgcaggtcagcatactgcggtgaatacgttcccgggccttgtacacaccgcccgtca

SEQ ID NO: 400 - DNA, 1518 bp, Artificial Sequence
  Synthetic Polynucleotide
  misc_feature (511)..(511): n is a, c, g, or t
  misc_feature (520)..(520): n is a, c, g, or t
gagtttgatyctggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggaggagaggcatctctcttccgtgaaagatggcctctgaacatgctatcacctgtcgatgggtctgcgtctgattagctggttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcgagaggtgaataaactcttgcaatgacggtacctgtcgaggaagmcncggctatcnacgtgccagcarccgcggtaatacgtaggtggcgagcgttgtccggaattattgggcgtaaagggagcgcaggcgggcatgtaagtctttcttaaaagttcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaagcatgcagagatgtatgtgtctyttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggtctgggctacacacgtactacaatggaacggacagagagcagcgaacccgcgagggtaggcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcgg

SEQ ID NO: 401 - DNA, 1401 bp, Artificial Sequence
  Synthetic Polynucleotide
aacgctggcggcgtgcttaacacacgcaagccgaacgaaagagcgacggaagcctgctttctatcaatcttagcggcgaacgggtcgagtaacgcgtaatcaacctgcccttcagagggggacaacagttcggaaacgaccgctaataccgcatacgattcaatctcggcatcgagactggatgaaaggtggcctctattcataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcaaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcggagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggcggagtatgtggtttaattcgacgcaacgcgaagaaccttaccaggtcttgacattgacggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcgaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtc

SEQ ID NO: 402 - DNA, 1412 bp, Artificial Sequence
  Synthetic Polynucleotide
acgctggcggcgtgcttaacacatgcaagtcgaccgtaaagcgatggaagcttgcttctatcaatcttaggggcgaacgggtgagtaacgcgtaatcaacctgcccttcaaagggggacaacagttggaaacgactgctaataccgcatacaatccaatctcggcatcaaaactggatgaaaggtggcctctatttataagctatcactgaaggagggaattgcgtctgattagctagttggaggggtaacggcccaccaaggcaatgatcagtagccggtctgaaaggatgaacggccacattgggactgaaacacggcccaaactcctacgggaggcagcagggggaaatcttccgcaatggacaaaagtctgacggaccaacgccgcgtgagtgatgacggccttcgggttgtaaagctctgttaatcgggacaaatggttcttgtgcgaatagtgcaaggatttgacggtaccggaataaaaagccacggctaactacgtgccagcagccgcggtaatacgtaggtggcaagcgttgtccggaattattgggcgtaaagcgcgcgcaggcgaattggtcagtctgtcttaaaagttcggggcttaaccccgtgatggaatggaaactgccaatctaaagtatcgaaaaggaaagtggaattcctagtgtagcggtgaaatgcgtaaatattaggaagaacaccagtggcgaaggcaactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcgg

SEQ ID NO: 403 - DNA, 1451 bp, Artificial Sequence
  Synthetic Polynucleotide
  misc_feature (1040)..(1040): n is a, c, g, or t
gaattcactagtgatttgagtggcaaacgggtgagtaacacgtaaacaacctgccttcaggatggggacaacagacggaaacgatgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatagatactaggtgtaggaggtatcgacccctcctgtgccggagttaacgcaataagtatcccgcctggaagtacgatcgcaagattaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcancgagcgcaacccctatcatttgttaccagcacgtagaggtggggactcaaatgagaccgccgcggacaacgcggaggaaggcggtgacgacgtcaagtcatcatgccccttatgacctgggctacacacgtactacaatgggtgtcaacaaagagaagcgtacccgcgaggaagagcaaacctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtacccg

SEQ ID NO: 404 - DNA, 1490 bp, Artificial Sequence
  Synthetic Polynucleotide
tggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaaccttggcatcgaggatggatgaaaggtggcctctatttataagctatcactgaaggaggggattgcgtctgattagctagttggaggggtaacggcccaccaaggctatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccgcagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaagcaggtggtgcacggttgtcgtcagctcgtgtcgtgagatgttgggttaagtcccgcaacgagcgcaacccctatcttatgttgccagcacgtaaaggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccatgagagttggcaatacccaaagtgcgtgatctgactcgcaagagaggaagcgccctaaggtagggtcagcgattggggtgaagtcgtaaca

SEQ ID NO: 405 - DNA, 1513 bp, Artificial Sequence
  Synthetic Polynucleotide
gatgaacgctggcggcgtgcttaatacatgcaagtcgagcgaagcgctttaacggaattctccggaaggaagataaagtgactgagcggcggacgggtgagtaacgcgtgggtaacctgcctcatacagggggataacagttagaaatggctgctaataccgcataagcgcacaggaccgcatggtctggtgtgaaaaactccggtggtatgggatggacccgcgttggattaggtagttggtggggtaacggcctaccaagccgacgatccatagccggcctgagagggtggacggccacattgggactgagacacggcccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgagggagagcaaagctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtagccgtatcggaagg

SEQ ID NO: 406 - DNA, 1416 bp, Artificial Sequence
  Synthetic Polynucleotide
gagtttgatcatggctcaggacgaacgctggcggcgtgcttaacacatgcaagtcaaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgtggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagtcaggggagcgaacgagattagataccccggtagtgctggccctaaacgatgggtactaggtgtaggaggtatcgaccctttccgtgccggagttaaggcaatcagtaccccgcgtggggagtacgaccgcaaggttgaaactcaaaggaatcgacgggggcccgcacaagcggtggactatgtggtttaattcgacgcaacgcgaagaaccttaccaggtcttgacattgatggacagaaccagagatggttcctcttgttcggaagccagaaaacaggcggtgcacggtcgtcgtcagctcgtgtcgtgagatgttgggttaagtcccgcaatgagcgcaacccctatctcatgttgccagcaggtaacggtgggaactcatgagagactgccgcagacaatgcggacgaaggcggggatgacgtcaaatcatcatgcccgctctgacctgggctacacacgtactacaacgggagttaatagacggaagtgagatcgcgagatggagcaaacccgagaaacactctctcagttcggatcgtaggctgcaactcgcccacgcgaagtcggaatcgctagtaatcgcaggtcagcatactgcggtgaatacgttcccgggcctcgcacacaccgc

SEQ ID NO: 407 - DNA, 1490 bp, Artificial Sequence
  Synthetic Polynucleotide
agagtttgattctggctcaggacgaacgctggcggcgtgcttaacacatgcaagtcgaacgggaggaaaagagaagcttgcttctttttgaatctagtggcaaacgggtgagtaacacgtaaacaacctgccttcaggatggggacaacagacggaaacgactgctaataccgaatgtgttccggagaccgcatgatttccggaagaaaggatggcctctatttataagctatcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatggacgaaagtctgacggagcaacgccgcgtgagtgatgacggccttcgggttgtaaagctctgtgattcggggacgaatggctggtatgctaataccatatcagagtgacggtacccgaatagcaagccacggctaactacgtgccagcagccgcggtaatacgtaggtggcaagcgttgtccggaattattgggcgtaaagcgcgcgcaggcggcttcttaagtccatcttaaaagtgcggggcttaaccccgtgatgggatggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgccagaattaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgg

SEQ ID NO: 408 - DNA, 1478 bp, Artificial Sequence
  Synthetic Polynucleotide
ctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcctcttgcgaatagttagaggaattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcagcctcctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagaccgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtga

SEQ ID NO: 409 - DNA, 1491 bp, Artificial Sequence; identical to SEQ ID NO: 197
  Synthetic Polynucleotide

SEQ ID NO: 410 - DNA, 1459 bp, Artificial Sequence
  Synthetic Polynucleotide
tggcggcgtgcttaacacatgcaagtcgaacgataagagggaaagagcttgctctttccggaattgagtggcaaacgggtgagtaacacgtaaacaacctgccttcaggatggggacaacagacggaaacgactgctaataccgaataagttccaagggccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccgaaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggaccaaaactgacgctgaggcgcgaaagcgtgggggagcaaacaggattagatacccctggtagtccacgccgtaaccgatggattctaggtgtaggaggtatcgacccctcctgtgccggagttatcgcaataagtatcccgcctgggaagtacgatcgcaagattaaaactcaaaggaattgacgggggtccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtctcgcaacgagcgcaacccctatcatttgttaccagcacgtaaaggtggggactcaaatgagtccgccgcggacaacgcggaggaagtcggggacgacgtcaagtcatcatgccccttatgacctgggctactcacgtacttcaatgggtgtcaacaaagagaagcgataccgcgaggaagagccatcctcaaaaacacacccccagttcagatcgcaggctgcaacccgcctgcgtgaaggaggaatcgttagtaatcgcgggtctgcataccgcggtgaatacgttcccgggcgttgtacacccctcccgtcaccttatgcgagtcagtaacacccgaagcaaaagaggtaaccgcaaggatccagccgtc

SEQ ID NO: 411 - DNA, 1427 bp, Artificial Sequence
  Synthetic Polynucleotide
agagtttgatcctggctcaggacgaacgctggcggcgtgcttaacacatgcaagtcgaacgagaggaagagagaagcttgcttctttctgaatctagtggcaaacgggtgagtaacacgtaaacaacctgccttcaggatggggacaacagacggaaacgactgctaataccgaatacgttccttgaatcgcatgatttaaggaagaaagggtggcctctacttgtaagctatcgcctgaagaggggtttgcgtctgattaggtagttggtgaggtaacggcccaccaagccgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtcgatgaaataatacttcattgaagtgacggtacccgaatagcaagccacggctaactacgtgccagcagccgcggtaatacgtaggtggcaagcgttgtccggaattattgggcgtaaagcgcacgcaggcggttttctaagtccatcttaaaagtgcggggcttaaccccgtgatgggatggaaactggaagactggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattgatcgctatctgcagaaatgcggagttctccttcgggagacgagaaaacaggtggtgcacggctgtcgtcagctcgtgtcgtgagatgttggttaagtcccgcaacgagcgcaacccctatcttatgttaccagcacgttatggtggggactcatgagagaccgccgcggacaacgcggaggaaggtggggatgacgtcaagtcatcatgccccttatgacctgggctacacacgtactacaatgggtgtcaacaaagagaagcgaagccgcgaggcagagcaaacctcaaaaacacacccccagttcagattgcaggctgcaactcgcctgcatgaagtaggaatcgctagtaatcgcgggtcagcataccgcggtgaatacgttcccgggccttgcacacaccgcccgtca

SEQ ID NO: 412 - DNA, 1546 bp, Artificial Sequence
  Synthetic Polynucleotide
  misc_feature (1343)..(1343): n is a, c, g, or t
  misc_feature (1347)..(1347): n is a, c, g, or t
  misc_feature (1350)..(1350): n is a, c, g, or t
  misc_feature (1353)..(1354): n is a, c, g, or t
  misc_feature (1357)..(1358): n is a, c, g, or t
ttcgcccttagagtttgatcctggctctggacgaacgctggcggcgtgcttaacacatgcaagtcgaacgaaaagacggaaagagcttgctcttttcagaattgagtggcaaacgggtgagtaacacgtaaacaacctgcctgcgggagggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcgggcttcccaagtccctcttaaaagtgcggggcttaacccggtgatgggaaggaaactgggaagctggagtatcggagaggaaagtggaattcctagtgtagcgggtgaaatgcgtagagattagggaagaacaccggtggcgaaggcgactttctggacgaaaaactgacgggggggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcaatctgcagaaatgcggagttcttcttcggaagacgagaaaacaggtggtgcacggctgtcgtcagctcgtgtcgtgagatgttgggttaagtcccgcaacgagcgcaacccctatcatttgttgccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaaaccgcgaggaagagcaaacctcaaaaacacacccccagttcagatagnaggntgnaannggnntgggtgaagcaggaatcccccccccccgggggtcagcataccgcggtgaatacgttcccgggccttgtacacaccgcccgtcacactatgagagtcagaaacacccgaagccggtgaggtaaccgcaaggagccagcagtcgaaggcggagctgatgattggagtgaagtcgtctcaaggtagccgta

SEQ ID NO: 413 - DNA, 1420 bp, Artificial Sequence
  Synthetic Polynucleotide
agagtttgatcctggctcaggatgaacgctagctacaggcttaacacatgcaagtcgaggggcagcatggtcttagcttgctaaggctgatggcgaccggcgcacgggtgagtaacacgtatccaacctgccttcaggatggggacaacagacggaaacgactgctaataccgaatacgcttgggagaccgcatgatctaccaaggaaagggtggcctctacctgtaagctatcgcccgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtccgtaagctaataccttatggaagtgacggtacccgaatagcaagccacggctaactacgtgccagcagccgcggtaatacgtaggtggcaagcgttgtccggaattattgggcgtaaagcgcgcgcaggcggctttctaagtccatcttaaaagtgcggggcttaaccccgtgatgggatggaaactgggaagctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattgatcgccattcacagaaatgtgaagttctccttcgggagacgagaaaacaggtggtgcacggctgtcgtcagctcgtgtcgtgagatgttgggttaagtcccgcaacgagcgcaacccttactgtcagttactacgcaagaggactctggcaggactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtctcagttcggactggggtctgcaacccgactccacgaagctggattcgctagtaatcgcgcatcagccacggcgcggtgaatacgttcccgggccttgcacacaccgcccgt

SEQ ID NO: 414 - DNA, 1579 bp, Artificial Sequence; identical to SEQ ID NO: 256
  Synthetic Polynucleotide

SEQ ID NO: 415 - DNA, 1565 bp, Artificial Sequence
  Synthetic Polynucleotide
tggagagtttgatcctggctcaggacgaacgctggcggcgtgcttaacacatgcaagtcgaacgagaggacatgaaaagcttgctttttatgaaatctagtggcaaacgggtgagtaacacgtaaacaacctgccttcaagatggggacaacagacggaaacgactgctaataccgaatacgatccgaaagtcgcatgacatttggatgaaagggtggcctatcgaagaagctatcgcttgaagaggggtttgcgtccgattaggtagttggtgaggtaacggcccaccaagccgacgatcggtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgattcgggacgaaaggccatatgtgaataatatatggaaatgacggtaccgaaaaagcaagccacggctaactacgtgccagcagccgcggtaatacgtaggtggcaagcgttgtccggaattattgggcgtaaagcgcgcgcaggcggtcacttaagtccatcttagaagtgcggggcttaaccccgtgatgggatggaaactgggagactggagtatcggagaggaaagtggaattcctagtgtagcggtgaaatgcgtagatattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagtcttgacattgatcgccattccaagagattggaagttctccttcgggagacgagaaaacaggtggtgcacggctgtcgtcagctcgtgtcgtgagatgttgggttaagtcccgcaacgagcgcaacccctatcttttgttgccagcacgtagaggtgggaactcagaagagaccgccgcagacaatgcggaggaaggtggggatgacgtcaagtcatcatgccccttatgacttgggctacacacgtactacaatgggctttaacaaagagcagcgaaaccgcgaggtggagcgaaactcaaaaacaagcccccagttcagatcgcaggctgcaactcgcctgcgtgaagcaggaatcgctagtaatcgcgggtcagcataccgcggtgaatacgttcccgggccttgtacacaccgcccgtcacactatgagagtcggaaacacccgaagccggtgaggtaaccgcaaggagccagccgtcgaaggtggggctgatgattggagtgaagtcgtaacaaggtagccgtatcggaaggtgcggctggatcacctcctttct

SEQ ID NO: 416 - DNA, 1526 bp, Artificial Sequence
  Synthetic Polynucleotide
agagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatttaatctcggcatcgaggatagatgaaaggtggcctctacatgtaagctatcactgaaggaggggattgcgtctgattagctagttggaggggtaacggcccaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcctaatgcgaatagttttaggcaatgacggtacccatcgaggaagccacggctaactacgtgccagcagccgcggtaatacgtaggtggcgagcgttgtccggaatcattgggcgtaaagggagcgcaggcgggcatgtaagtctttcttaaaagtgcggggctcaaccccgtgatgggaaagaaactatgtgtcttgagtacaggagaggaaagcggaattcccagtgtagcggtgaaatgcgtagatattgggaggaacaccagtggcgaaaggcggctttctggactgcaactgacgctgaggctcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacgtaaaggtgggaactcatgagagactgccgcagacaatgcggaggaaggcggggacgacgtcaaatcatcatgccccttatgacctgggctacacacgtactacaatgggagttaatagacggaagcaagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtaacc

SEQ ID NO: 417 - DNA, 1469 bp, Artificial Sequence
  Synthetic Polynucleotide
ggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgaggatggatgaaaggtggcctctatttataagctatcactgaaggaggggattgcgtctgattagctagttggagggataacggcccaccaaggcaatgatcagtacccggtctgagaggatgaacggccacattgagactgacacacggcccagactcctacgggaggcagcagtggggaatcttccgcaatggacgaaagtctgacggagcaacgccgcgtgagtgatgacggccttcgggttgtaaagctctgttaatcgggacgaaaggtcttcttgcgaatagttagaggaattgacggtaccggaatagaaagccacggctaactacgtgccagcagccacggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagcactccgcctggggagtacgaccgcaaggttgaaactcaaaggaattgacgggggcccgcacaagcggtggagtatgtggtttaattagacgcaacgcgaagaaccttcccaggtcttgacattgatggacagaactagagatagttcgtcttgttcggaagccagaaaacaggtggtgcacggttgtcgtcagctcgtgtcgtgagatgttgggttaagtcgtgcaacgagcgcaacccctatcttatgttgccagcacgtaatggtgggaactcatgagagactgccgcagacaatgcggaggaaggcggggatgacgtcaaatcatcatgccccttatgacatggggtacacacgtactacaatgggagttaatagacgggagagagatcgcgagatggagcaaacccgagaaacactctgtcagttcggatagtagggtgcaactctcgtatgcgaagttggaatcgctagtaatctcaggtcagcatattgcggtgaatacgttcccgggccttgtacacaccgcccgtcacaccacgaaagtcggaagtgcccaaagccggtggggtaaccttcgggagccagccgtctaaggtaaagtcgatgattgg

SEQ ID NO: 418 - DNA, 1483 bp, Artificial Sequence
  Synthetic Polynucleotide
acgaacgctggcggcgtgcctaacacatgcaagtcgaacggagaattttatttcggtataattcttagtggcgaacgggtgagtaacgcgtacgcaacctgccctttatacggggacaacattccgaaaggagtgctagtaccggatgtgatcatcgtgcctcatggcacgatgaaaaaagatggcctctactagtaagctatcgctaaaggatgggcctgcgtctgattagctagttggtagtgtaatggactaccaaggcgatgatcagtagccggtctgagaggatgaacggccacattgggactgagacacggcccaaactcctacgggaggcaacagtggggaatcttccgcaatggacgaaagtctgacggagcaacgccgcgtgagtgatgaaggatttcggtctgtaaagctctgttgtttatgacgaacgtgcagtgtgtgaacaatgcattgcaatgacggtagtaaacgaggaagccacggctaactacgtgccagcagccgcggtaatacgtaggtggcgagcgttgtccggaattattgggcgtaaagagcatgtacgcggcttaataagtcgagcgtgaagatgcggggctcaaccccgtatggcgctggaaactgttaggcttgagtgcaggagaggaaaggggaattcccagtgtagcggtgaaatgcgtagatattgggaggaacaccagtggcgaaggcgcctttctggactgtgtctgacgctgagatgcgaaagccatggtagcgaacgggattagataccccggtagtcctggctgtaaacgatgggtactaggtgtaggaggtatcgacccgttctgtgccggagttaacgcaataagtacaccgcgtggggagtacggcggcaaggttgaaactcaaaggaattgacgggggcccgcacaagcggtggagtatgtggtttaattggacgcaacgcgaagaaccttaccaaggcttgacattgattgaatgctctagagatagagatttcccttcggggacaagaaaacaggtggtgcatggctgtagtcagctcgtgtcgtgagatgttgggttaagtcccgcaatgagcgcaacccctatcctatgttaccagcaagtaaagttggggactcatgggagactgccagggacaacatggaggaaggcggggatgacgtcaagtcatcatgccccttatgtcttgggctacacacgtactacaatggtcggaaacagagggaagcgaagccgcgaggcagagcaaaccccagaaacccgatttcagtttggatcgcaggctgcaacctgcctgcgtgaagttggaatcgctagtaattgcaggtcagcatactgcggtgaatacgttcccgggccttgtacacaccgcccgtcacaccacgaaagttggtaacacccgaagccggtgaggtaacctattaggagccagccgtctaaggtggggccgatgattggggtgaag

SEQ ID NO: 419 - DNA, 1426 bp, Artificial Sequence
  Synthetic Polynucleotide
ggctccgggcgaacgccggcggcgtgcctcacacacgcaagttcgaacgaaaaagacggaaagagcctcgctcttttcgaatcgagcggcaaacgggcgagtcacacgtaaacaacccgctctcaggacggggacaacagaacggaaacgaccgctaatcccgaataagtttccaagagccgcacggcccacggaaaaaaagggggcctctacccgtaagctatcgcctgaagaggggtttcgcgttctgattatccggttcggagggggtaacggcccaccaaggcgacgaatcagtagccggtctgagaggatgaacggccacactggaactgagacacggtccagactcctacgggaggcagcagtggggaatcttccgcaatgggcgaaagcctgacggagcaacgccgcgtgagtcgatgacggccttcgggttcgtaaaactctgtgattccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggctttccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaaaccgcgaggaagagcaaacctcaaaaacacacccccagttcagatcgcaggctgcaacccgcctgcgtgaagcaggaatcgctagtaatcgcgggtcagcataccgcggtgaatacgttcccgggccttgcacacaccgcccgtc

SEQ ID NO: 420 - DNA, 1461 bp, Artificial Sequence
  Synthetic Polynucleotide
ctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtcctccctcctccgcatggaggagggaggaaagatggcctctgcttgcaagctatcgctggaagatgggcccgcgtctgattagctagttggtggggtaacggctcaccaaggcgatgatcagtacccggtctgagaggatgaacggccacattgggactgagacacggcccaaactcctacgggaggcagcaatggggaatcttccgcaatggacgaaagtctgacggagcaacgccgcgtgagtgatgaaggtcttcggattgtaaaactctgttgttagggacgaaagcaccgtgtccgaacaggtcatggtgttgacggtacctaacgaggaagccacggctaactacgtgccagcagccgcggtaatacgtaggtggcaagcgttgtccggaattattgggcgaaaagagcatgtaggcgggcttttaagtctgacgtgacaatgcggggcttaaccccgtatggcgttggatactggaagtcttgagtgcaggagaggaaaggggaattcccagtgtagcgatgaaatgcgtagatattgggaggaacaccagtggcgaaggcgcctttctggactgtgtctgacgctgagatgcgaaagccagggtagcaaacgggattagataccccggtagtcctgaccgtaaacgatggatactaggtgtaggaggtatcgaccccttctgtgcaggagttaacgcaataagtatcccgcctggggattacgatcgcaagattgaaactcaaaggaattgacgggagaccgcacaagcggtggagtatgtggtttaattagacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtctcgcaacgagcgcaacccctatcctatgttaccagcgagtaaaggcggggactcataggagactgccagggataacctggaggaaggcggggaggaggtcaagtcatcatgccctttacgtgttgggctacacacgtactacaatggtcggcaacaaagggcagcgaaaccgcgaggtggagcaaatcccagaaacccgaccccagttcggatagtagggtgcaacctgcctacgtgaagttggaatagctagtaatcgcaggtcagcatactgcggcgaatacgttcccgggccttgtacaccccgcccgtcacaccacgaaagttggtaacacccgaagccggtgagataaccttttaggagtcagctgtctaaggtggggccgat

SEQ ID NO: 421 - DNA, 1418 bp, Artificial Sequence
  Synthetic Polynucleotide
gagtttgatttctggctcaggacgaacgctggcggcgtgcttaacacatgcaagtcgaacgaagagcgacggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttccttttcttcggaagctcagaaaacaggtggtgcacggttgtcgtcagctcgtgtcgtgagatgttgggttaagtcccgcaacgagcggcaacccctatcttatgttgcccagcactttgggtggggactcatgagagactgccgcggacaatgcggagaaaggcggggatgaacgtcgaaatctccttgccccttatgaacctgggctaccctcgtactataatggaagttaatagaacgaaggcgagattcgcgagatggagcaaccccgagaaaacgctctctcggttcggatcgagggctgcaaacacgcctacgtgaagtcggaatcgctattaatcgcaggtcagcgtactgcggtaaatacgtcctcgggccttgta

SEQ ID NO: 422 - DNA, 1416 bp, Artificial Sequence
  Synthetic Polynucleotide
gagtttgattcatggctcaggacgaacgctggcggcgtgcttaacacatgcaagtcgaacgaaaagacggaaagagcttgctcttttcagaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagcaggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagtttttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcgtgccccttatgacctgggctacgcgcgtactacgatgggtgtcgaacgaagagaaagcgaaaaccgcgaggaagagcgaacctcgaaaaacgcgcccccggttcggtttcgcgggctgcactccgctctgcgtaagcggggatcgctgttattcgcgggttctgcttaccgcggtaatgcgttcccgggcctt

SEQ ID NO: 423 - DNA, 1410 bp, Artificial Sequence; identical to SEQ ID NO: 128
  Synthetic Polynucleotide

SEQ ID NO: 424 - DNA, 1407 bp, Artificial Sequence
  Synthetic Polynucleotide
gagtttgatcatggctcaggacgaacgctggcggcgtgcttaacacatgcaagtcgaacgaagagaaatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaattgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgtaacccctatcttatgttgccagcacttcgggtgggaactcatgagagactgccgcagacgatgcggaggaaggcggggatgacgtcaaatcatcatgccccttatgacctgggctacacacgtactacgatgggagttaatagacggaaagcgaaagccgcgaggtggagcgaaacccggaaaacgctctctcggttcgattcggagagctgcgactcgcctacgtaaagtcgaaatcgctaggaacgcgggtcggcggactgcggtaaagacgttcccgggcctt

SEQ ID NO: 425 - DNA, 1451 bp, Artificial Sequence; identical to SEQ ID NO: 252
  Synthetic Polynucleotide

SEQ ID NO: 426 - DNA, 1371 bp, Artificial Sequence
  Synthetic Polynucleotide
  misc_feature (10)..(10): n is a, c, g, or t
  misc_feature (70)..(72): n is a, c, g, or t
  misc_feature (692)..(692): n is a, c, g, or t
  misc_feature (1360)..(1360): n is a, c, g, or t
aacctgcctncaagatggggacaacactccgaaaggggtgctaataccgaatgttgtaatgctgctgcannncagtattaccaaaggtggcttttagctatcgcttggagatgggcctacgtctgattagctagttggtgacggtaacggcgcaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgaggaaggtcttcggatcgttaagttctgttgcaggggacgaacggcactatagccaataagtatagtgaatgacggtaccctgttagaaagccacggctaactacgtgccagcagccgcggtaatacgtaggcggcaagcgttgtccggaattattgggcgtaaagggagcgcaggcggaacattaagcggatcttaaaagtgcggggctcaaccccgtgatggggtccgaactgaggttcttgagtgcaggagaggaaagcggaattcccagtgtagcggtgaaatgcgtagatattgggaagaacaccagtggcgaaggcggctttctggactgtaactgacgctgaggctcgaaagccagggtagcgaacgggattagataccccggtagtcctngccgtaaacgatggatactaggtgtagggggtattgaccctttctgtgccggagcaaacgcaataagtatcccgcctggggagtacgaccgcaaggttgaaactcaaaggaattgacgggggcccgcacaagcggtggagtatgtggtttaattcgaagcaacgcgaagaaccttaccagggcttgacattgattgacgtatccagagatggatattttctcttcggaggacaagaaaacaggtggtgcatggctgtcgtcagctcgtgtcgtgagatgttgggttaagtcccgcaacgagcgcaacccctatcatttgttgccagcacgtaaaggtgggaactcaagtgagactgccgcggacaacgcggaggaaggcggggatgacgtcaagtcatcatgccccttatgtcctgggctacacacgtactacaatgggataaacagagggaagcgagaccgcgaggtggagcgaaacccataaattatctctcagttcggattgcaggctgcaactcgcctgcatgaagtcggaatcgctactaatcgcaggtcagcatactgcggtgaatacgttcccgggtcttgtacacaccgcccgtcacaccacgaaagtcatccacacccgaagccggctaagggccgcaaggcaccgaccgtctaaggtnggggcgatgac

SEQ ID NO: 427 - DNA, 1553 bp, Artificial Sequence
  Synthetic Polynucleotide
gagtttgattctggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggaggagaggcatctcccctccgtgaaagatggcctcttttaatgctatcacctgtcgatgggtccgcgtctgattagctggttggaggggtaacggcccaccaaggcgacgatcagtagccggtctgagaggatgaccggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactggggagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgagggagagcaaagctcaaaaacacacccccagttcagatcgcaggctgcaacccgcctgcgtgaagtaggaatcgctagtaatcgcgggtcagcgtaccgcggtgaatacgttcccgggtcttgtacacaccgcccgtcacaccacgggagtcggaaacacccgaagccgattatccaaccgcaaggaggaagtcgtcgaaggtggcgtcgataactggggtgaagtcgtaacaaggtagccgtatcggaaggtgcggctggatcacctcctt

SEQ ID NO: 428 - DNA, 1496 bp, Artificial Sequence
  Synthetic Polynucleotide
agagtttgatcctggctcaggacgaacgctggcggcgtgcttaacacatgcaagtcgaacggagctgtttatttcggtagatagcttagtggcaaacgggtgagtaacgcgtaggcaacctgcccttaggatggggacaacggcccgaaaggaccgctaataccgaatggactctaactttcgcatggaagaaagaggaaagatggtgcaagccatcgccgaaggaagggcctgcgtctgattagccagttggtgaggtaacggcccaccaaagcgacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgtcggggacgaaaggaaaggggaggcaatgccccttttaagacggtacccgacgaggaagccacggctaactacgtgccagcagccgcggtaatacgtaggcggcaagcgttgtccggaattattgggcgtaaagggagcgcaggtgggacggtaagtccgtcttaaaaggcaggggctcagcccctgtaagggatggaaactatcgttcttgagtgccggagaggaaagcggaattcccagtgtagcggtgaaatgcgtagatattgggaagaacaccagtggcgaaggcggctttctggacggcaactgacactgaggctcgaaagccagggtagcgaacgggattagataccccggtagtcctggccgtaaacgatggatactaggtgtagggggtatcgacccctcctgtgccggagttaacgcaataagtatcccgcctggggagtacggtcgcaagactgaaactcaaaggaattgacgggggcccgcacaagcggtggagtatgtggtttaattcgacgcaacgcgaagaaccttaccagggcttgacattgagtgaaaggcgtagagatacgtcccttatcttcggataacacgaaaacaggtggtgcatggctgtcgtcagctcgtgtcgtgagatgttgggttaagtcccgcaacgagcgcaacccctgttctttgttgccatcacgttatggtgggcactcaaaggagactgccgcggagaacgcggaggaaggcggggatgacgtcaagtcatcatgccccttatggtctgggctacacacgtactacaatggaacggacagagagcagcgaacccgcgagggcgagcgaacctcaaaaaccgtttcccagttcgggttgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtaaccgt

SEQ ID NO: 429 - DNA, 1481 bp, Artificial Sequence
  Synthetic Polynucleotide
gacgaacgccggtggcgtgcttaacacatgcaagtcgaacggagaattatttcggtaattcttagtggcgaacgggtgagtaacgcgtagacaacctaccttttagatggggacaacatcgcgaaagcggtgctaataccgaatgttgataatgaaatgcatgtttcgttatttaaagatggcctctatatataagctatcgctaaaagatgggtctgcgtctgattagctagttggtgagataacagcccaccaaggcaacgatcagtagccggtctgagaggatgaacggccacattgggactgagacacggcccaaactcctacgggaggcagcagtggggaatcttccgcaatggacgaaagtctgacggagcaacgccgcgtgagtgaagaaggttttaggatcgtaaagctctgttgtttaggacgaatgtgccttatgcgaatagtatgaggtaatgacggtactaaacgagaaagccacggctaactacgtgccagcagccgcggtaatacgtaggtggcaagcgttgtccggaattattgggcgtaaagggagcgcaggtgggaaaataagtctgttttaaaagtgcggggctcaaccccgtgatggaatggaaactgtttttcttgagtgcaggagaggaaagtggaattcctagtgtagcggtgaaatgcgtagatattaggaggaacaccagtggcgaaggcgactttctggactgtaactgacactgaggctcgaaagccagggtagcgaacgggattagataccccggtagtcctgaccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccagggcttgacattgattgaaagacgtagagatacgtacctcttcttcggaagacaagaaaacaggtggtgcatggctgtcgtcagctcgtgtcgtgagatgttgggttaagtcccgcaacgagcgcaacccctatcatttgttgccagcacgtaaaggtgggaactcaaatgagactgccgcggataacgcggaggaaggcggggatgacgtcaagtcatcatgccccttatgtcctgggctacacacgtactacaatgggattgacagagggaagcgaaatcgcgagatggagcaaaccccagaaacaatctctcagttcggattgtaggctgcaactcgcctacatgaagtcggaatcgctagtaatcgcaggtcagcatactgcggtgaatacgttcccgggccttgtacacaccgcccgtcacaccacgaaagtcagtcacacccaaagccggtggggtaactctaacgagagctagccgtctaaggtggggccgatgattggggtgaa

SEQ ID NO: 430 - DNA, 1407 bp, Artificial Sequence; identical to SEQ ID NO: 145
  Synthetic Polynucleotide

SEQ ID NO: 431 - DNA, 1474 bp, Artificial Sequence; identical to SEQ ID NO: 296
  Synthetic Polynucleotide

SEQ ID NO: 432 - DNA, 1419 bp, Artificial Sequence
  Synthetic Polynucleotide
gatcctggctcaggacgaacgctggcggcgtgcttaacacatgcaagtcgaacgagaagagatgagaagcttgcttcttatcaattcgagtggcaaacgggtgagtaacgcgtaagcaacctgccctctagatggggacaacagctggaaacggctgctaataccgaatacgttctttctgtcgcatggcagagggaagaaagggaggctcttcggagctttcgctggaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatacgggacgaatggtacgacggccaatacccgtcgtaagtgacggtaccgtaagagaaagccacggctaactacgtgccagcagccgcggtaatacgtaggtggcaagcgttgtccggaattattgggcgtaaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtagaaggtatcgaccccttctgtgccggagttaatgcaataagtatcccgcctggggagtacggccgcaaggcagaaactcaaaggaattgacgggggcccgcacaagcggtggagtatgttgttttattcgacgcaacgtcgaagaaccttaccaagccttgacattgattgctaagggtagagataccctgttcctcttcggaggacaagaaaacaggtggtgcacggctgtcgtcagctcgtgtcgtgagatgttgggttaagtcccgcaacgagcgcaacccctatcttctgttaccagcggttcggccggggactcaggagagactgccgcagacaatgcggaggaaggcggggatgacgtcaagtcatcatgccccttatggcttgggctacacacgtactacaatggtctcttaatagagggaagcgaaggagcgatccggagcaaaccccaaaaacagagttcccagtccggattgcaggctgcaacccgcctgtcatgaagcaggaatcgtgctagtaatcgcaggttcagtcatactgcggtgaatacgtttcccgggtcctgtcacacaccg

SEQ ID NO: 433 - DNA, 1424 bp, Artificial Sequence
  Synthetic Polynucleotide
tagtggcgaacgggtgagtaacgcgtaatcaacctgcccttcagagggggacaacagttggaaacgactgctaataccgcatacgatctaacctcggcattcaggatagatgaaaggtggcctctatttttaagctatcactgaaggaggggattgcgtctgatatgcgatagtgaggggggacggggccccccggcggatgaccagtgccggtttgagaggatgaacggccaccattggactgagacacggcccagactcctacgggaggcagcagtggggaatcttccgcaatggacgaaagtctgacggagcaacgccgcgtgagtgatgacggccttcgggtttaaagcttcgttaatcgggaagaaagggcctctgcgcgaacagtgagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgagtgaaagggcaagagattgtccccttatcttcggataacacgaaaacaggtggtgcatggttgtcgtcagctcgtgtcgtgagatgttgggttaagtcccgcaacgagcgcaacccctatcttatgttgccagcacttcgggtgggaactcatgagagactgccgcagacaatgcagaggaaggcggggatgacgtcaaatcatcatgccccttatgacctgggctacacacgtactacaatgggagttaatagacggaagcgagatcgcgagatggagcaaacccgagaaacactctttcagttcggatggtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggaaaagtcgtaa

SEQ ID NO: 434 - DNA, 1511 bp, Artificial Sequence; identical to SEQ ID NO: 204
  Synthetic Polynucleotide

SEQ ID NO: 435 - DNA, 1389 bp, Artificial Sequence; identical to SEQ ID NO: 175
  Synthetic Polynucleotide

SEQ ID NO: 436 - DNA, 1408 bp, Artificial Sequence
  Synthetic Polynucleotide
  misc_feature (978)..(978): n is a, c, g, or t
  misc_feature (1042)..(1042): n is a, c, g, or t
  misc_feature (1090)..(1090): n is a, c, g, or t
gacgaacgctggcggcgttgcttaacacattgcaagtcgaacgaagagcgattggaagctttgcttctatcaatcttagtggcgaacgggtgagtaacgcgtaatcaacctgccccttcagagggggacaacagttggaaacgactgctaataccgcatacgatccaatctcggcatcgaggatggatgaaaggtggcctctatttataagctatcactgaaggaggggattgcgtctgattagctagttggaggggtaacggcccaccaaggcgatgatcagtagcctgtctgagaggatgaacggccacattgggactgagacacggcccagactcctacgggaggcagcagtggggaatcttccgcaagggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggactggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgacgcctacaaggtgtaggaggtatcgcccctttctgagccggagttagcgcaataagtcccccgcctggggagtacgaccgcaagtttgaaactcaaaggaatgaccggggggccgccacaagcggtggagtatgtgtttaattcgacgcaacgcgagaaccnttaccaggtctgaccatgatgggacagacccagagatggttcctcttcttcgaagcccagaaanccaggtggtgcacggttgtcgtcagctcgtgtcgtgagatgttgggtnaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtactcaccgcccgtca

SEQ ID NO: 437 - DNA, 1518 bp, Artificial Sequence
  Synthetic Polynucleotide
agagtttgatcctggctcaggacgaacgctggcggcgtgcttaacacatgcaagtcgaacggaaggagaaggaagcttgctttcttcgaatttagtggcgaacgggtgagtaacgcgtaaacaacctgccttcgggatggggacaacagacggaaacgactgctaataccgaatgaattctctatgccgcatgacaaagagaagaaaggagcctttaaagctccgcctgaagaggggtttgcgtctgattaggtagttggtggggtaacggcctaccaagcctgcgatcagtagccggtctgagaggatgaacggccacactggaactgagacacggtccagactcctacgggaggcagcagtggggaatcttccgcaatgggcgaaagcctgacggagcaacgccgcgtgagtgatgaaggccttcgggttgtaaaactctttgattcgggacgaaagacatgaggaggaaatgccttatgagtgacggtaccgaaagaacaagccacggctaactacgtgccagcagccgcggtaatacgtaggtggcaagcgttgtccggaattattgggcgtaaagcgcgcgcaggcggctttttaagtccatcttaaaagcgtggggctcaaccccatgatgggatggaaactggagagctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatggatactaggtgtaggaggtatcgacccttctgtgccggagctaacacaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgccatctcaagaaattgagagttctccttcgggagacgagaaaacaggtggtgcacggctgtcgtcagctcgtgtcgtgagatgttgggttaagtcccgcaacgagcgcaacccctatcttctgttgccagcacgtaatggtgggaactcaggagagactgccgcagacaatgcggaggaaggcggggatgacgtcaagtcatcatgccccttatggcttgggctacacacgtactacaatgggcgtaaacaaagagaagcgaaagggcgacccggagcaaacctcaaaaacacgcccccagttcagatcgcaggctgcaactcgcctgcgtgaagcaggaatcgctagtaatcgcgggtcagcataccgcggtgaatacgttcccgggccttgtacacaccgcccgtcacactatgagagtcggaaacacccgaagccggtggggtaaccgtaaggagccagccgtctaaggcggagccgatgattggagtgaagtcgtaacaaggtaacc

SEQ ID NO: 438 - DNA, 1558 bp, Artificial Sequence
  Synthetic Polynucleotide
gagagtttgatcctggctcaggacgaacgctggcggcgtgcttaacacatgcaagtcgaacgaaaatagggaaagagcttgctctttccggaattgagtggcaaacgggtgagtaacacgtaaacaacctgccttcaggatggggacaacagacggaaacgactgctaataccgaataagttccaagagccgcatggcccatggaaaaaaaggtggcctctacctgtaagctatcgcctgaagaggggtttgcgtctgattagctggttggaggggtaacggcccacccaggcgacaatcgatagccggtctgacaggatgaacggccacactggaactgaaacccggtccaaactcctacgggaggcacctctggggaatcttccgcactgggcgaaagcctgaccgagcaacgccacgtgattgatgacggccttctggttggaaaactctgtgatccgggacgaaaaggcagagtgcgaaaaacaaactgcattgacggtaccggaaaagcatgccacggctaactacctgccatcagccgcggtaatacgtaggtggcaagcgttgtccggaattattgggcgtaaggcgcgcgcaggcggattcccaagtccctcttacaagtgcggagcttaaccccgtgatgggagggaaactggtaagctggagtatcggagagaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggtggtatcgacccctcctgtgccggagttaacgcaatacgtatcccgcctgggaagtacgatcgcaagattaattactcaagggaagtgacgggggcccgcacaagcggtggagtatgtggtataattagacgcaacgagaagaaccttcacatgtcttgacattgatcgggatgagcagaaatgcggagtttttcttcggaagacgagaaaacacgtggtgcacggctgtgttcagatcgtgtcttgagatgttgggttaagtctcgcaacgagcgcaacccctatcatttgttgccaccacgtaaaggtggggactcaaatgagaccgccgcggacaacgcggaggaaggcggggacgacgtcaagtcatcatgccccttatgacctgggctacacacgtactacaatgggtgtcaacaaagagaagcgaaaccgcgaggaagagcaaacctcaaaaacacacccccagttcagatcgcaggctgcaacccgcctgcgtgaagcaggaatcgctagtaatcgcgggtcagcataccgcggtgaatacgttcccgggccttgtacacaccgcccgtcacactatgagagtcagaaacacccgaagccggtgaggtaaccgcaaggagccagccgttgaaggcggagctgatgattggagtgaagtcgtaacaaggtagccgtatcggaaggtgcggctggatcacct

SEQ ID NO: 439 - DNA, 1438 bp, Artificial Sequence
  Synthetic Polynucleotide
tttagtggcgaacgggtgagtaacgcgtagacaacctaccttttaaatggggacaacactgcgaaagtggtgctaataccgaatgttattgctggaatgcatgttctagcaattaaagatggcctctgcttgcaagctatcgctaaaagatgggtctgcgtctgattagctagttggtgagataacagcccaccaaggcaacgatcagtagccggtctgagaggatgaacggccacattgggactgagacacggcccaaactcctacgggaggcagcagtggggaatcttccgcaatggacgaaagtctgacggagcaacgccgcgtgagtgaagaaggttttcggatcgtaaagctctgttttttaggacgaatgtacagtatgcgaatagtgtattgtaatgacggtactaaacgagaaagccacggctaactacgtgccagcagccgcggtaatacgtaggtggcaagcgttgtccggaattattgggcgtaaagggagcgcaggtggaaaatcaagtctgttttaaaagtgcggggctcaaccccgtgagggaatggaaactggttttcttgagtgcaggagaggaaagtggaattcctagtgtagcggtgaaatgcgtagatattaggaggaacaccagtggcgaaggcgactttctggactgtaactgacactgaggctcgaaagctaggggagcgaacgggattagataccccggtagtcctagccgtaaacgatgggtactaggtgtgggaggtatcgaccccttctgtgccggagttaacgcaataagtaccccgcctggggagtacggccgcaaggttgaaactcaaaggaattgacggggacccgcacaagcggtggagtatgtggtttaattcgacgcaacgcgaagaaccttaccaggacttgacattgattgaaagacgtagagatacgtaactcttcttcggaagacaagaaaacaggtggtgcatggctgtcgtcagctcgtgtcgtgagatgttgggttaagtcccgcaacgagcgcaacccctattatttgttgccagcacgtaaaggtgggaactcaaataagactgccgcggataacgcggaggaaggcggggatgacgtcaagtcatcatgccccttatgtcctgggctacacacgtactacaatgggattgacagagggaagcgaagtcgcgaggcagagcaaaccccagaaacaatctctcagttcggattgtaggctgcaactcgcctacatgaagtcggaatcgctagtaatcgcaggtcagcatactgcggtgaatacgttcccgggtcttgtacacaccgcccgtcacaccacgaaagtcattcacacccaaagccggtggggtaaccagcaatggaactagccgtctaaggtgggggcgatgattggggtgaagtcgtaacaaggtagcc

SEQ ID NO: 440 - DNA, 1426 bp, Artificial Sequence
  Synthetic Polynucleotide
atcctggctcaagacgaacgcctggcggcgtgcttaacacattgcaagttcgaacgaagagcgattggaaagcctgcctttcatcaatcttagttggcgaaacgggttgagtaacgcgtaatcaacctgccctttcagagggggacaacagttggaaacgactgctaataccgcatacgatctaatctcggcatcgaggatagatgaaaaggtggcctctatttataagctatcactgaaggaggggattcgcgtctgaattagctagttggaggggtaacggcccaccaaggcgatgattcagtagccggtctgagaggatgaacggccacattgggactgagacacggcccagactcctacgggaggcagcagtggggaatcttccgcaatggacgaaagtctgacggagcaacgccgcgtgagtgatgacggccttcgggtttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaaacccgagaaacactctctcagttcggatcgtaggctgcaaactcgcctacgtgtagtcggaatcgctagtaatcgcaggtcagcttactgcggtgatacgttcccgggcccttgcacacaccgcc

SEQ ID NO: 441 - DNA, 1418 bp, Artificial Sequence
  Synthetic Polynucleotide
aacgccggcggcgagcctcacacacgcaagtccgaaacggaaagagaacgaaagagcctcgcttctttcatcaattcagcggcaaacgggtcgagtaacacgtaaacaacccgccttaacgccggggggaacagacggaaacgaccgctaataccgaatacgtttctaagcatcgcatgatgcatagaagaaaagggtcggcctctacaagaaagctatcgcctttaagaggggtttcgcgactgattaggtagtttggtgaggtaacggctcaccaagccgacgatcagtagccggtctgagaggatgaacggccacactggaactgagacacggtccagactcctacgggaggcagcagtggggaatcttccgcaatggacgaaagtctgacggagcaacgccgcgtgaacgaagaaggtcttcggattgtaaagttctgtgattcgggacgaaagggtttgtggtgaataatcatagacattgacggtaccgaaaaagcaagccacggctaactacgtgccagcagccgcggtaatacgtaggtggcaagcgttgtccggaattattgggcgtaaagcgcgcgcaggcggtttcttaagtccatcttaaaagcgtggggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgcaatccatagaaatatggagttcttcttcggaagacgagaaaacaggtggtgcacggctgtcgtcagctcgtgtcgtgagatgttgggttaagtcccgcaacgagcgcaacccctatttcctgttaccagcacgtaaaggtggggactcaggagagaccgccgcggacaacgcggaggaaggtggggatgacgtcaagtcatcatgccccttatggcttgggctacacacgtactacaatgggtgccaacaaagagaagcgaaatcgcgagatggagcggacctcataaacgcacccccagttcagattgcaggctgcaactcgcctgcatgaagtaggaatcgctagtaatcgcgggtcagcataccgcggtgaaatacgttcccgggccttgtacacaccgcccgtca

SEQ ID NO: 442 - DNA, 1526 bp, Artificial Sequence; identical to SEQ ID NO: 265
  Synthetic Polynucleotide

SEQ ID NO: 443 - DNA, 1479 bp, Artificial Sequence
  Synthetic Polynucleotide
gtgcttaacacatgcaagtcgaacgagaagagatgagaagcttgcttcttattaattcgagtggcaaacgggtgagtaacgcgtaagcaacctgcccttcagatggggacaacagctggaaacggctgctaataccgaatacgttctttccaccgcatgacgggaagaagaaagggaggccttcgggctttcgctggaggaggggcttgcgtctgattagctggttggaggggtaacggctcaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatatgggacgaacagggcatcggttaatacccggtgtctttgacggtaccgtaagagaaagccacggctaactacgtgccagcagccgcggtaatacgtaggtggcaagcgttgtccggaattattgggcgtaaagggcgcgcaggcggcatcgcaagtcggtcttaaaagtgcggggcttaaccccgtgaggggaccgaaactgtgaagctcgagtgtcggagaggaaagcggaattcctagtgtagcggtgaaatgcgtaggtattaggaggaacaccagtggcgaaagcggctttctggacgacaactgacgctgaggcgcgaaagccaggggagcaaacgggattagataccccggtagtcctggccgtaaacgatggatactaggtgtaggaggtatcgactccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctacggaaagagatttccggctcttcttcggaagacaagaaaacaggtggtgcacggctgtcgtcagctcgtgtcgtgagatgttgggttaagtcccgcaacgagcgcaacccctatcttctgttgccagcacctcgggtggggactcagaagagactgccgcagacaatgcgggggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggcaaccgcaaggaaccagccgtcgaaggtgggggcgatgattggggtgaagtcataaca

SEQ ID NO: 444 - DNA, 1426 bp, Artificial Sequence
  Synthetic Polynucleotide
tcaggacgaacgctggcggcgtgcttaacacatgcaagtcgaacgaaaagacggaaagagcttgcttcttttcatagattgagcggcaaacgggcgagtaacacgtaaacaacctgccttcaggacggggacaacagacggaaacgactcgctaataccgaataagtttccaagagccgcatggcccatggaagaaaaggtggcctctacctgtaagctatcgcctgaagaggggtttgcgtctgatttagctggtttggaggggtaacggcccaccaaggcgacgattcagtagccggtctgagaggatgaacggccacactggaactgagacacggtccagactcctacgggaggcagcagtgggggattcttccgcaatgggcgaaagcctgacggagcaacgccgcgtgagtgatgacggccttcgggtttgtaaaactctgcgattccgggacgaaaaggcagaatgcgaagaaacaaactgcatttgacggtaccggaaaagcaagccacggctaactacgtgccagcagccgcggtaatacgtaggtggcaagcgttgtccggaatttattgggcgtaaagcgcgcgcaggcggctttccaagttcctcttaaaagtgcggggcttaaccccgtgatgggaaggaaactgggaagctggagtatcggagaggaaagtggaatttcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaaaccgcgaggaagagcaaacctcaaaaacacacccccagttcagatcgcaggctgcaacccgcctgcgtgaagcaggaatcgctagtaatcgcgggtcagcataccgcggtgaaatacgttcccgggccttgtacacaccgcccgtc

SEQ ID NO: 445 - DNA, 1528 bp, Artificial Sequence
  Synthetic Polynucleotide
agagtttgatcctggctcaggacgaacgctggcgacgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaaccttggcatcgaggatggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggatcggtcagtctgtcttaaaagttcggcgcttaaccccgtgatgggatggaaactgccaatctagagtatcggagaggaaagtggaattcctagtgtagcggtgaaatgcgtagatattaggaggaacaccagtggcgaaagcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgatcgcaaggagtagagatactctgttcttcttcggaagacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtctcagttcggattgtaggctgcaactcgcctacatgaagcaggaatcgctagtaatcgcaggtcagcatactgcggtgaatacgttcccgggccttgtacacaccgcccgtcacaccacgaaagtcattcacacccgaagccggtggcctaacccttgtggggggagccgtcgaaggtaggattggcgattgggactaagtcgtaacaaggtaacc

SEQ ID NO: 446 - DNA, 1552 bp, Artificial Sequence
  Synthetic Polynucleotide
gagagtttgattatggctcaggacgaacgctggcggcgtgcttaacacatgcaagtcgaacggaccgacatggaagcttgcttctatgaaggttagtggcgaacgggtgagtaacgcgtaatcaacctgcccatcagagggggacaacagttggaaacgactgctaataccgcatacgatccaatcccggcatcgggactggatgaaaggtggcctctacttgtaagctatcactgatggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaatggctaccatgcgaatagtttgggagtttgacggtaccggaatagaaagccacggctaactacgtgccagcagccgcggtaatacgtaggtggcaagcgttgtccggaattattgggcgtaaagcgcgcgcaggcggatctgccagtctgtcttaaaagttcggggctcaaccccgtgatgggatggaaactacagatctagagtatcggaggggaaagtggaattcctagtgtagcggtgaaatgcgtagatattaggaggaacaccagtggcgaaggcgactttctggacgatcactgacgctgaggcgcgaaagccaggggagcgaacgggattagataccccggtagtcctggccgtaaacgatgggtactaggtgtaggaggtatcgaccccttctgtgccgtagttaacgcagtaagtaccccgcctggggagtacggccgcaaggttgaaactcaaaggaattgacgggggcccgcacaagcggtggagtatgtggtttaattcgacgcaacgcgaagaaccttaccaggtcttgacattgatggacaggtccagagatggactctcttcttcggaagccagaaaacaggtggtgcacggttgtcgtcagctcgtgtcgtgagatgttgggttaagtcccgcaacgagcgcaacccctatcttatgttaccagcacttcgggtggggactcatgagagactgccgcagacaatgcggaggaaggcggggatgacgtcaaatcatcatgccccttatgacctgggctacacacgtactacaatggacgataacagagggaagcgaagccgcgaggtggagcgaaccccagaaactcgttctcagttcggattgcaggctgcaactcgcctgcatgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggttggaacacct

SEQ ID NO: 447 - DNA, 1384 bp, Artificial Sequence
  Synthetic Polynucleotide
gacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaacctcgtgatgggatggaaactagtaggttagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagctaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggcct

SEQ ID NO: 448 - DNA, 1528 bp, Artificial Sequence
  Synthetic Polynucleotide
  misc_feature (351)..(351): n is a, c, g, or t
  misc_feature (403)..(403): n is a, c, g, or t
  misc_feature (1116)..(1116): n is a, c, g, or t
  misc_feature (1125)..(1125): n is a, c, g, or t
  misc_feature (1174)..(1174): n is a, c, g, or t
  misc_feature (1296)..(1296): n is a, c, g, or t
gacgaacgctggcggcgtgcttaacacatgcaagtcgaacgggaagacatgaagagcttgctctttatgaaatccagtggcaaacgggtgagtaacacgtaaacaacctgccttcaggatggggacaacagacggaaacgactgctaataccgaatacgattcttgagtcgcatgacacaagaaagaaagggtggcctctacttgtaagctatcgcctggagaggggtttgcgtccgattaggtagttggtgaggtaacggcccaccaagccgacgatcggtagccggtctgagaggatgaacggccacattggaactgagacacggtccagactcctacgggaggcagcnagtggggaatcttccgcaatgggcgaaagcctgacggagcaacgccgcgtgnagtgaagacggccttcgggttgtaaaactctgtgattcgggacgaaagataagtagacgaataatctgcataagtgacggtaccgaaaaagcaagccacggctaactacgtgccagcagccgcggtaatacgtaggtggcaagcgttgtccggaattattgggcgtaaagcgcgcgcaggcggctacttaagtccatcttaaaagtgcggggcttaaccccgtgatgggatggaaactgagaagctggagtgtcggagaggaaagtggaattcctagtgtagcggtgaaatgcgtagagattaggaagaacaccggtggcgaaggcgactttctggacgacaactgacgcttaggcgcgaaagcgtggggagcaaacaggattagataccctggtagtccgcgccgtaaacgatggatactaggtgtaggaggtatcgaccccttctgtgccggagttaacgcgataagtatcccgcctgggaggtacgatcgcaagattaaaactcaaaggaattgacgggggcccgcacaagcggtggagtatgtggtttaattcgacgcaacgcgaagaaccttaccaggtcttgacattgatcgctattttcagaaatgagaagttctccttcgggagacgagaaaacaggtggtgcatcggctgtcgtcagctcgtgtcgtgagatgttgggttaagtcccgcaacgagcgcaacccntatccattntgttgccagcacgcgaaggtgggaactcaaatgagaccgccgcagaccnatgcggaggaaggcggggacgacgtcaagtcatcatgccccttatgacctgggctacacacgtactacaatgggtgtcaacaaagagaagcgaaggagcgatccggagcaaacctcaaaaancacacccccagttcagatcgcaggctgcaactcgcctgcgtgaagcaggaatcgctagtaatcgcgggtcagcataccgcggtgaatacgttcccgggccttgtacacaccgcccgtcacactatgagagtcggaaacacccgaagccggtgaggtaaccgcaaggagccagccgtcgaaggtggagctgatgattggagtgaagtcgtaacaaggtagccgtatcggaagg

SEQ ID NO: 449 - DNA, 1422 bp, Artificial Sequence
  Synthetic Polynucleotide
agagtttgatcctggctcaggacgaacgctggcggcgtgcttaacacatgcaagtcgaacggagagcgatggaagcttgcttctatcaatcttagtggcgaacgggtgagtaacgcgtaaccaacctgcccttcagagggggataacaacgggaaaccgttgctaataccgcgtacgattaagcttcggcatcgaagcttaatgaaaggtggcctctatatataagctatcgctgaaggagggggttgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatcacggccttcgggttgtaaagctctgttaatcgggacgaatggtctttgtgtgaacaatgcaaagatttgacggtaccggaatagaaagccacggctaactacgtgccagcagccgcagtaatacgtaggtggcaagcgttgtccggaattattgggcgtaaagcgcgcgcaggcggttttgcaagtctgtcttaaaagttcggggctcaaccccgtgatgggatggaaactgtggaactagagtatcggagaggaaagcggaattcctagtgtagcggtgaaatgcgtagatattaggaagaacaccagtggcgaaggcggctttctggacgacaactgacgctgaggcgcgaaagccaggggagcgaacgggattagataccccggtagtcctggccgtaaacgatgggtactaggtgtaggaggtatcgaccccctttgtgccggagttgacgcaataagtaccccgcctggggagtacggtcgcacgggtgaaactctaaggaattgacgggggcccgcacacgcggtggagtacgtggtttaatttgacgcaacgcgaagagcccttccaggtctcgacactgatggacgaaacaagagattgtttttctccctcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaataggctttaatagagggacgcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgcacacaccgcccgtca

SEQ ID NO: 450 - DNA, 1425 bp, Artificial Sequence
  Synthetic Polynucleotide
agagtttgatcctggctcaggacgaacgctggcggcgtgcttaacacatgcaagtcgaacgagaagagaaggaagcttgcttctttcagatctagtggcaaacgggtgagtaacacgtaaacaacctgccttcaggatggggacaacagacggaaacgactgctaataccgaatacgttccttaggtcgcatgatcttgggaagaaagggtggcctctacctgtaagctatcgcctgaagaggggtttgcgtctgattaggtagttggtgaggtaacggcccaccaagccgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtcggcaggacgaataatctgctgagttgacggtacccgaatagcaagccacggctaaatacgtgccagcagccgcggtaatacgtaggtggcaagcgttgtccggaattattgggcgtaaagcgcgcgcaggcggcttcttaagtccatcttaaaagtgcggggcttaaccccgtgatgggatggaaactgagaggctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtatgatcgcaagattaaaactcaaaggaattgacgggggcccgcacaagcggcggagtatgtggtttaattcgacgcaacgcgaagaaccttaccaggtcttgatattgatcgctattccaagaaattggaagttcctcttcggaggatcgaagacaggtggtgcatggttgtcgtcagctcgtgtcgtgagatgttgggttaagtcccgcaacgagcgcaacccttatggtcagttactaacgcgtagaggcgaggactctgacaagactgccggggacaactcggaggaaggtggggacgacgtcaaatcatcatgccccttatgacctgggctacaaacgtgctacaatggtggttacaaagaggagcgagcatgtaaatgtaagcggatctcaaaaaagccatcccagttcggattgtgggctgcaacccgcccacatgaagttggagttgctagtaatcgcggatcagcatgccgcggtgaatacgttcccgggccttgcacacaccgcccgtca

SEQ ID NO: 451 - DNA, 1463 bp, Artificial Sequence; identical to SEQ ID NO: 241
  Synthetic Polynucleotide

SEQ ID NO: 452 - DNA, 1374 bp, Artificial Sequence
  Synthetic Polynucleotide
  misc_feature (975)..(992): n is a, c, g, or t
agtggcaaacgggtgagtaacgcgtaaacaacctgccctccagatggggacaacagctggaaacggctgctaataccgaatacgatctaaaggccgcatgacctttagaagaaaagatggccactgaatagtctatcgccggaagaggggtttgcgtctgattagctagttggaggggtaacggcccaccaaggcaatgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttttatgggacgaacgggygtatggtcaatacccatacgccgtgacggtaccgtaagagaaagccacggctaactacgtgccagcagccgcggtaatacgtaggtggcaagcgttgtccggaatcattgggcgtaaagggcgcgcaggcggttcggtaagtcggtcttaaaagtgcggggcttaaccccgtgatgggattgaaactgccggactggagtgtcggagaggaaagcagaattcctagtgtagcggtgaaatgcgtagatattaggaggaataccagtggcgaaagcggctttctggacgacaactgacgctgaggcgcgaaagccaggggagcaaacgggattagataccccggtagtcctggccgtaaacgatggatactaggtgtaggaggtatcgaccccttctgtgccggagttaacgcaataagtatcccgcctggggagtacggccgcaaggttgaaactcaaaggaattgacgggggccgcacaagcggtggagtatgtggtttaattcgacgcaacgcgaagaaccttaccaagccttgacattgagtgccagggatagagatatcctgttcttcttcggaagacgcgaaaacaggtggtgcnnnnnnnnnnnnnnnnnntgtcgtgagatgttgggttaagtcccgcaacgagcgcaacccctatcttctgttgccagcacgtaaaggtgggaactcagaagagactgccgcagacaatgcggaggaaggcggggatgacgtcaagtcatcatgccccttatggcttgggctacacacgtactacaatggctcttaatagagggaagcgaaaggagccgatcctggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaacc

SEQ ID NO: 453 - DNA, 1409 bp, Artificial Sequence; identical to SEQ ID NO: 37
  Synthetic Polynucleotide

SEQ ID NO: 454 - DNA, 1481 bp, Artificial Sequence
  Synthetic Polynucleotide
gctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatatgggacgaacaggatgacggttaatacccgttgtccctgacggtaccgtaagagaaagccacggctaactacgtgccagcagccgcggtaatacgtaggtggcaagcgttgtccggaattattgggcgtaaagggcgcgcaggcggcatcgcaagtcggtcttaaaagtgcggggcttaaccccgtgaggggaccgaaactgtgaaactcgagtgtcggagaggaaagcggaattcctagtgtagcggtgaaatgcgtagatattaggaggaacacccagtggcgaaagcggctttctggacgacaactgacgctgaggcgcgaaagccaggggagcaaacgggattagataccccggtagtcctggccgtaaacgatggatactaggtgtaggaggtatcgactccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctacggaaagagatttccggttcttcttcggaagacaagaaaacaggtggtgcacggctgtcgtcagctcgtgtcgtgagatgttgggttaagtcccgcaacgagcgcaacccctatcttctgttgccagcactaagggtggggactcagaagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggcaaccgcaaggaaccagccgtcgaaggtgggggcgatgattggggtgaagtcg

SEQ ID NO: 455 - DNA, 1405 bp, Artificial Sequence; identical to SEQ ID NO: 36
  Synthetic Polynucleotide

SEQ ID NO: 456 - DNA, 1462 bp, Artificial Sequence
  Synthetic Polynucleotide
acatgcaagtcgaacgaaaagagggaccctttttgctctttccggaattgagtggcaaacgggtgagtaacacgtaaacaacctgccttcaggatggggacaacagacggaaacgactgctaataccgaataagttccaagggccgcagggcccaaggaagaaaaggtggcctctacctgtaagctatcgcctgaagaggggtttgcgtctgattagctggatggaggggtaacggcccaccaaggcgacgatcagtagccggtctgagaggatgaacggccacactggaactgagacacggaccagacacctacgggaggcagcagtggggaatcttccgcaatgggcgaaagcctgacggagcaacgccgcgtgagggagggcgggcaacgggaagtaaaactctgtgatccgggacgaaaaggcagagagcgaagaacaaactgcattgacggtaccggaaaagcaagccacggctaactacgtgccagcagccgcggtaatacgtaggaggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgagggagagcaaagctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggggccagccgtcgaaggcggagctgatgattgg

SEQ ID NO: 457 - DNA, 1428 bp, Artificial Sequence
  Synthetic Polynucleotide
tagtggcgaacgggtgagtaacgcgtagacaacctgcctcttagatggggacaacatcgcgaaagcggtgctaataccgaatgaagtggagcttccgcatggaagcatcaccaaaggtggcctctatttataagctaccactgagagatgggtctgcgtctgattagctagttggcggggtaatggcccaccaaggcgacgatcagtagccggtctgagaggatgaacggccacattgggactgagacacggcccaaactcctacgggaggcagcagtggggaatcttccgcaatggacgaaagtctgacggagcaacgccgcgtgagtgaagaaggttttcggatcgtaaagctctgttgtttgagacgaatgtgcagactttgaataagggtttgtaatgacggtattaaacgagaaagccacggctaactacgtgccagcagccgcggtaatacgtaggtggcaagcgttgtccggaattattgggcgtaaagggagcgcaggtgggaatgtaagtcagtcttaaaagtgcggggctcaaccccgtgaggggattgaaactacatttcttgagtgcaggagaggaaagtggaattcctagtgtagcggtgaaatgcgtagagattaggaggaacaccagtggcgaaggcgactttctggactgtaactgacactgaggctcgaaagccaggggagcgaacgggattagataccccggtagtcctggccgtaaacgatggatactaggtgtgggaggtatcgaccccttccgtgccggagttaacgcaataagtatcccgcctggggagtacggccgcaaggctgaaactcaaaggaattgacggggacccgcacaagcggtggagtatgtggtttaattcgacgcaacgcgaagaaccttaccagggcttgacattgagtgaaagatctagagatagattcctgttcttcggaacacacaaaaacaggtggtgcatggctgtcgtcagctcgtgtcgtgagatgttgggttaagtcccgcaacgagcgcaacccctatcctatgttgccagcacgtaaaggtgggaactcatgggagactgccgcggagaacgcggaggaaggcggggatgacgtcaagtcatcatgccccttatgtcctgggctacacacgtactacaatgggatgaacagagggaagcgagaccgcgaggtggagcgaaccccagaaatcatctctcagttcggattgcaggctgcaactcgcctgcatgaagtcggaatcgctagtaatcgcaggtcagcatactgcggtgaatacgttcccgggtcttgtacacaccgcccgtcacaccacgaaagtcattcacacccgaagccggtggggtaaccgtaaggagctagccgtctaaggtgggggcgatgattggggtgaagtcgtaacaag

SEQ ID NO: 458 - DNA, 1425 bp, Artificial Sequence; identical to SEQ ID NO: 278
  Synthetic Polynucleotide

SEQ ID NO: 459 - DNA, 1512 bp, Artificial Sequence
  Synthetic Polynucleotide
  misc_feature (603)..(603): n is a, c, g, or t
  misc_feature (1454)..(1454): n is a, c, g, or t
  misc_feature (1488)..(1488): n is a, c, g, or t
agagtttgatcatggctcaggacgaacgctggcggcgtgctttaacacatgcaagtcgtacgagacgattgaaagcttgcttttgaaagtcgagtggcaaacgggtgagtaacgcgtagacaacctgccgtaaagatggggacaacagtccgaaaggactgctaataccgaatgttgtggaacttccgcatgggagctctactaaagatggcctctacttgtaagctatcgctttacgatgggtctgcgtctgattagctagttggtggggtaacggcttaccaaggcgacgatcagtagccggtctgagaggatgaacggccacattggaactgagacacggtccagactcctacgggaggcagcagtggggaatcttccgcaatgggcgcaagcctgacggagcaacgccgcgtgagtgaagaagggtttcgactcgtaaagctctgttgtcggggacgaatgtgragatggtgaataaccgttttcaatgacggtacctgacgaggaagccacggcttaactacgtgccagcagccgcgggtaatacgtaggtggcgagcgttgtccggaattattgggcgtaaagggagcgcaggcggnaggtcaagtctatcttaaaagtgcggggctcaaccccgtgaggggatggaaactggtcttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgacccctcctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattgagtgaaaggactagagatagtcccctctcttcggagacacgaaaacaggtggtgcatggctgtcgtcagctcgtgtcgtgagatgttgggttaagtcccgcaacgagcgcaacccctatcctttgttgccagcacataatggtgggaactcaaaggagactgccgcggacaacgcggaggaaggcggggatgaccgtcaagtcatcatgccccttatgtcctgggctacacacgtactacaatgggatggacagagagcagcgaagccgtgaggccaagcgaaccccataaaccatctcccagttcggattgcaggctgcaacccgcctgcatgaagttggaatcgctagtaatcgcaggtcagcatactgcggtgaataccttcccgggccttgtacacaccggccgttacaccacggaagtcatttacaccccaagccngcaaggctaacccgcaaggaagcagccgtctaangtggggggcgatgactggggtgaa

SEQ ID NO: 460 - DNA, 1533 bp, Artificial Sequence
  Synthetic Polynucleotide
agagtttgatcctggctcaggacgaacactggcggcgtgcttaacacatgcaagtcgaacgggaagaaaaagaagagcttgctctttttttggattctagtggcaaacgggtgagtaacacgtaaataacctgccttcaggatggggacaacagacggaaacgactgctaataccgaataccttccaatttccgcatggagataggaagaaagggtggcctctacttgtaagctatcgcctgaagaggggtttgcgtctgattagctagttggtgaggtaacggcccaccaaggcgacgatcagtagccggtctgagaggatgaacggccacactggaactgagacacggtccagactcctacgggaggcagcagtggggaatcttccgcaatggacgaaagtctgacggagcaacgccgcgtgaacgatgaaggtcttcggattgtaaagttctgtgatccgggacgaaggcatcaattgagaatattgattgatgttgacggtaccggaaaagcaagccacggctaactacgtgccagcagccgcggtaatacgtaggtggcaagcgttgtccggaattattgggcgtaaagcgcgcgcaggcggccgtgcaagtccatcttaaaagcgtggggcttaaccccatgaggggatggaaactgcatggctggagtgtcggaggggaaagtggaattcctagtgtagcggtgaaatgcgtagagattaggaagaacaccggtggcgaaggcgactttctagacgacaactgacgctgaggcgcgaaagcgtggggagcaaacaggattagataccctggtagtccacgccgtaaacaatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgcaatctgcagaaatgcggagttcctcttcggaggacgagaaaacaggtggtgcacggctgtcgtcagctcgtgtcgtgagatgttgggttaagtcccgcaacgagcgcaacccctatcttctgttgccagcacgtaaaggtgggaactcaggagagaccgccgcggacaacgcggaggaaggcggggatgacgtcaagtcatcatgccccttatggcttgggctacacacgtactacaatgggtgcaaacaaagagaagcgaagtcgcgagacggagcggacctcataaacgcactcccagttcagattgcaggctgcaacccgcctgcatgaagtaggaatcgctagtaatcgcgggtcagcataccgcggtgaatacgttcccgggccttgtacacaccgcccgtcacactatgagagtcggagacacccaaagccggtgggataaccgaaagggatcagccgtctaaggtggagctgatgattggagtgaagtcgtaacaaggtagcc

SEQ ID NO: 461 - DNA, 1520 bp, Artificial Sequence
  Synthetic Polynucleotide
agagtttgatcatggctcaggacgaacgctggcggcgtgcttaacacatgcaagtcgaacgggaaacttatttcggtaagtttctagtggcgaacgggtgagtaacgcgtgggtaacctgccctccagatggggacaacattccgaaagggatgctaataccgaatacgatccctccaccgcatggaggagggatgaaagatggcctctgcctgcaagctatcgctggaagatggacccgcgtctgattagctggttggtgaggtaacggcccaccaaggcgatgatcagtagccggtctgagaggatgaacggccacattgggactgagacacggcccaaactcctacgggaggcagcagtggggaatcttccgcaatgggcgaaagcctgacggagcaacgccgcgtgagtgatgaaggtcttcggattgtaaaactctgttgtcagggacgaatgcatcgatttacaatacactttgatgttgacggtacctgacgaggaagccacggctaactacgtgccagcagccgcggtaatacgtaggtggcaagcgttgtccggaatcattgggcgtaaagagcatgtaggcgggcttttaagtccgacgtgaaaatgcggggcttaaccccgtattgcgttggatactgggagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccggagttaacgcaataagtatcccgcctggggactacgatcgcaagattgaaactcaaaggaattgacgggggcccgcacaagcggtggagtatgtggtttaattcgacgcaacgcgaagaaccttaccaaggcttgacattgagtgaaagacctggagacaggtccccctcttcggaggcacgaaaacaggtggtgcatggctgtcgtcagctcgtgtcgtgagatgttgggttaagtcccgcaacgagcgcaacccttatcctatgttaccagcacgtaaggtggggactcataggagactgccagggataacttggaggaaggcggggatgacgtcaagtcatcatgccccttatgtcttgggctacacacgtactacaatggtcggcaacaaagggcagcgataccgcgaggtggagcaaatcccataaacccgaccccagttcggatcgcaggctgcaacccgcctgcgtgaagttggaatcgctagtaatcgcaggtcagcatactgcggtgaatacgttcccgggccttgtacacaccgcccgtcacaccacgaaagttggtaacacccgaagccggtgagataaccttttaagagtcagctgtctaaggtggggccgatgattggggtgatgacgtaacaaggtaaccgta

SEQ ID NO: 462 - DNA, 1396 bp, Artificial Sequence
  Synthetic Polynucleotide
gagtttgatcatggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggaggagaggcatctctcctccgtgaaagatggcctctatttataagctatcacctgtcgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtacggagtgcgaatagtgctctgtaatgacggtacctgtcgaggaagccacggctaactacgtgccagcagccgcggtaatacgtaggtggcgagcgttgtccggaatcattgggcgtaaagggagcgcaggcgggcgtgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttgattcgaagcaacgcgaagaaccttaccaggccttgacattgactgaaagtgctagagatagcaacctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggtctgggctacacacgtactacgaatggaacggacagagagcagcgaaacccgcgagggcaagcgaaacctcgaaaaaccgttttcccggttcggattgcgggctgcgaactcgcctgcgtgaaagttcggaaatcgctagtgaatcgcgggtcagcggactgcggtgaa

SEQ ID NO: 463 - DNA, 1382 bp, Artificial Sequence
  Synthetic Polynucleotide
gatgaacgctggcggcgtgcttaacacatgcaagtcgagcgaagcacttatgaaagattcttcggatgatttcatttgtgactgagcggcggacgggtgagtaacgcgtgggtaacctgcctcatacagggggataacagttggaaacgactgctaataccgcataagcgcacagtgtcgcatgacacagtgtgaaaagctccggtggtatgagatggacccgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcgacttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaaaccgcgaggaagagcaaacctcaaaaacacacccccagttcagatcgcaggctgcaacccgcctgcgtgaagcaggaatcgctagtaatcgcgggtcagcataccgcggtgaatacgttcccgggcct

SEQ ID NO: 464 - DNA, 1380 bp, Artificial Sequence
  Synthetic Polynucleotide
gatgaacgctggcggcgtgcttaacacatgcaagtcgaacgaagcacttatctttgattcttcggatgaagaggtttgtgactgagtggcggacgggtgagtaacgcgtgggtaacctgcctcatacagggggataacagttagaaatgactgctaataccgcataagcgcacagtactgcatggtacagtgtgaaaaactccggtggtatgagatggacccgcgtctgattagctagttggaggggtaacggcccaccaaggcgatgatcagtagccggtctgagaggatgaacggccacattgggactgagacacggcccagactcctacggaaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcggaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttctccggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggcct

SEQ ID NO: 465 - DNA, 1491 bp, Artificial Sequence
  Synthetic Polynucleotide
aacgctggcggcgtgcttaacacatgcaagtcgaacgaagcgcttaaacggatttcttcggattgaagtttttgcgactgagtggcggacgggtgagtaacgcgtaagcaacctgcccttcagatggggacaacagctggaaacggctgctaataccgaatacgttctttccgccgcatgacggaatgaagaaagggaggccttcgggctttcgctggaggaggggcttgcgtctgattagctagttggaggggtaacggcccaccaaggcgacgatcagtagccggtctgagaggatgaacggccacattgggactgagacacggcccaggctcctacgggaggcagcagtggggaatcttccgcaatggacgaaagtctgacggagcaacgccgcgtgaacgatgacggccttcgggttgtaaagttctgttatatgggacgaacaggataacggttaatacccgttatccctgacggtaccgtaagagaaagccacggctaactacgtgccagcagccgcggtaatacgtaggtggcaagcgttgtccggaattattgggcgtaaaaggcgcgcaggcggcatcgcaagtcggtcttaaaagtgcggggcttaaccccgtgaggggaccgaaactgtgaagctcgagtgtcggagaggaaagcgggattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtaggaggtatcgactccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctacggaaagagatttccggttcttcttcggaagacaagaaaacaggtggtgcacggctgtcgccagctcgtgtcgtgagatgttgggttaagtcccgcaacgagcgcaacccctatcttctgttgccagcactatgggtggggactcagaagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggcattgtacacaccgcccgtcacaccacgaaagtcattcacacccgaagccggtgaggcaaccgcaaggaaccagccgtcgaaggtgggggcgatgattggggtgaa

SEQ ID NO: 466 - DNA, 1462 bp, Artificial Sequence
  Synthetic Polynucleotide
gctggcggcgtgcttaacacatgcaagtcgaacgaaaagagggaaagagcttgctcttttcggaattgagtggcaaacgggtgagtaacacgtaaacaacctgccttcaggatggggacaacagacggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccaatggggtaaccttcgggagccagccgtctaaggta

SEQ ID NO: 467 - DNA, 1480 bp, Artificial Sequence
  Synthetic Polynucleotide
gcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgggactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcaaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattccctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaactgacgggggcccgcacaagcggtggagtatgtggtttaattcgacgcaacgcgaagaaccttaccaggtcttgacattgatggatagaaccagagatggttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgagagtttgtaacacccgaagtcggtgaggtaaccatttggagccagccgcctaaggtgggatagatgattggggtgaagtcataaca

SEQ ID NO: 468 - DNA, 1393 bp, Artificial Sequence
  Synthetic Polynucleotide
gagtttgattcatggctcaggacgaacgctggcggcgtgcttaacacatgcaagtcgaacgaagagcgatgggagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaatgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaacctcgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattaatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacgaatggctcttaatagagggaagcgaaggagcgatccggagcgaaaccccgaaaaacgagagtctcggttcggattgtaggctgcgaactcgcctacgtgaaagcgggaatcgctagtgaatcgcgggtcagcggactgcggt

SEQ ID NO: 469 - DNA, 1528 bp, Artificial Sequence
  Synthetic Polynucleotide
gtttgatcctggctcaggacgaacgctggcggcgtgcttaacacatgcaagtcgaacgagagcgtagagaaagcttgctttttctacaatctagtggcaaacgggtgagtaacgcgtaaacaacctgccctacggatggggacaacagctggaaacggctgctaataccgaatacgttccgaaagtcgcatgactatcggaagaaaggatggcctctatttataagctatcgccggaggaggggtttgcgtctgattagctagttggaggggtaacggcccaccaaggcgacgaccagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatacgggacgaatagtcttgtggttaatacccataagaagtgacggtaccgtaagagaaagccacggctaactacgtgccagcagccgcggtaatacgtaggtggcaagcgttgtccggaattattgggcgtaaagggcgcgcaggcggcttcttaagtctgtcttaaaagtgcggggcttaacccccgtgatgggatggaaactgggaagctcagagtatcggagaggaaagcggaattcctagtgtagcggtgaaatgcgtagatattaggaggaacaccagtggcgaaagcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttaccagcacttcgggtggggactcatgagagactgccgcagacaatgcggaggaaggcggggatgacgtcaaatcatcatgccccttatgacctgggctacacacgtactacaatggacgataacagagggaagctaagccgcgaggtggagcgaacccccagaaactcgttctcagttcggattgcaggctgcaactcgcctgcatgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccg

SEQ ID NO: 470 - DNA, 1465 bp, Artificial Sequence
  Synthetic Polynucleotide
gctcatgacgaacgctggcggcgtgcttaacacatgcaagtcgaacggagaacttatttcggtaagttcttagtggcgaacgggtgagtaacgcgtgggcaacctgccctccagttggggacaacattccgaaagggatgctaataccgaatgtgctccctcctccgcatggaggagggaggaaagatggcctctgcttgcaagctatcgctggaagatgggcccgcgtctgattagctagttggtggggtaacggctcaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaaactctgttgttagggacgaaagcaccgtgttcgaacaggtcatggtgttgacggtacctaacgaggaagccacggctaactacgtgccagcagccgcggtaatacgtaggtggcaagcgttgtccggaattattgggcgtaaagagcatgtaggcgggcttttaagtctgacgtgaaaatgcggggcttaaccccgtatggcgttggatactggaagtcttgagtgcaggagaggaaaggggaattcccagtgtagcggtgaaatgcgtagatattgggaggaacaccagtggcgaaggcgcctttctggactgtgtctgacgctgagatgcgaaagccagggtagcaaacgggattagataccccggtagtcctggccgtaaacgatggatactaggtgtaggaggtatcgaccccttctgtgccgggggtgagggcaataagtgtcccgcctgggggattagagtcgcaagattgaaactcaaaggaatggacgggggccccgcacaagcggtggagtatgtggtttaatttgacgcaacgcgaagaaccttaccaaggcttgacattgagtgaaagacctagagataggtccctcccttcggggacacgaaaacaggtggtgcatggctgtcgtcagctcgtgtcgtgagatgttgggttaagtcccgcaacgagcgcaacccctatcctatgttaccagcgcgtaaaggcggggactcataggagactgccagggataacttggaggaaggcggggatgacgtcaagtcatcatgccccttatgtcttggggtacacacgtactacaatggtcggcaacaaagggcagcgaaaccgcgaggtggagcaaatcccagaaacccgaccccagttcggatcgtaggctgcaacccgcctacgtgaagttggaatcgctagtaatcgcaggtcagcatactgcggtgaatacgttcccgggccttgtacacaccgcccgtcacaccacgaaagttggtaacacccgaagccggtgagataaccttttaggagtcagctgtcta

SEQ ID NO: 471 - DNA, 1365 bp, Artificial Sequence; identical to SEQ ID NO: 269
  Synthetic Polynucleotide

SEQ ID NO: 472 - DNA, 1417 bp, Artificial Sequence
  Synthetic Polynucleotide
agtttgatcatggcccaagaccaacgctggccgcctgcctaacacctgccagttcaaccgaaccaatgaaagcctgcttttataagcctagtggccaacgggtgagtaacacctagaccacccgccgaccggatggggaaaacattccgaaaggaatgctaataccgaatgaagtccagggaaggcatcttcccttgatgaaagatggcccccttttatgctatcacctgtttgatgggtccgcctctgattagctggtaggtgaggtaacggctcacctaggcgacgattcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcctaatgcgaatagttttaggcaatgacggtacccatcgaggaagccacggctaactacgtgccagcagccgcggtaatacgtaggtggcgagcgttgtccggaatcattgggcgtaaagggagcgcaggcgggcatgtaagtctttcttaaaagtgcggggctcaaccccgtgatgggaaagaaactatatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagttagagataactccctctcttcggagacaggaaaacaggtggtgcatggctgtcgtcagctcgtgtcgtgagatgttgggttaagtcccgcaacgagcgcaacccctgttctttgttgccagcgtgtaaagatgggcactcaaaggagactgccgcagagaacgcggaggaaggcggggatgacgtcaagtcatcatgccccttatggtctgggctacacacgtactacaatgggacggacagagggcagcgagagagtgatcttaagcgaatctcaaaaaccgtttctcagttcggattgcaggctgcaactcgcctgcatgaagtcggaatcgctagtaatcgcaggtcagcatactgcggtgaatacgttcccgggtcttgtacacaccgcccgtc

SEQ ID NO: 473 - DNA, 1379 bp, Artificial Sequence
  Synthetic Polynucleotide
agagtttgatctggctcaggacgaacgctggcggcgtgcttaacacatgcaagtcgaacggagaatttatttcggtaaatttttagtggcgaacgggtgagtaacgcgtaggcaacctgccctttggatggggacaacattccgaaaggagtgctaataccgaatgtgatccatttctcgcatgagagatggatgaaagatggcctctatttataagctatcgccaaaggatgggcctgcgtctgattagctagttggtggggtaacggctcaccaaggctgtgatcagtagccggtctgagaggatgaacggccacattgggactgagacacggcccaaactcctacgggaggcagcagtggggaatcttccgcaatggacgaaagtctgacggagcaacgccgcgtgagtgatgaaggttttcggactgtaaaactctgttgtcagggacgaacatgcgatctgcaaatagttgatcgtattgacggtacctgacgaggaagccacggctaactacgtgccagcagccgcggtaatacgtaggtggcaagcgttgtccggaattattgggcgtaaagagcatgtaggtgggcttttaagtccgatgtgaaaatgcggggctcaaccccgtatggcattggatactggaagtcttgagtgcaggagaggaaaggggaattcccagtgtagcggtgaaatgcgtagatattgggaggaacaccagtggcgaaggcgcctttctggactgtgtctgacactgagatgcgaaagctagggtagcaaacgggattagataccccggtagtcctagccgtaaacgatgggtaaatgggtgtcgggtggcaaagccattcagagccgcactcaacgcaaatagtagtccaccgtgggagtaccttcgcagaaatgaaactcaaaggagtcgacgggaacccgcacaatcagtggagcatgtggttaaattcgaagcaacgcgaagaaccttacctgcccttgacatccttttgaccggcgagtaatgtcgcctatccttcgggacagaagagacaggtggtgcatggttgtcgtcagctcgtgtcgtgagatgttgggttaagtcccgcaacgagcgcaacccttatcttcagtagccagcatttcggatgggcactctggagagactgccagggataacctggaggaaggtggggatgacgtcaaatcatcatgccccttatgggcagggctacacacgtgctacaatggcgtaaacaaagggaggcaaagccgcgaggccgagcaaatctcaaaaataacgtctcagttcggaaagtagtctgcaactcgactacatgaagctggaatcgctagtaatcgcgaatcagaatgtcgcggtgaa

SEQ ID NO: 474 - DNA, 1418 bp, Artificial Sequence
  Synthetic Polynucleotide
gagtttgatcctggctcaggacgaacgctggcggcgtgcttaacacatgcaagtcgaacgggataatttgagagcttgctcttagagaatctagtggcaaacgggtgagtaacacgtagacaacctgccgacaggatggggacaacattccgaaaggaatgctaataccgaatgaagttgagggagggcatcctccttcgatgaaagatggcctctgaacatgctatcacctgtcgatgggtctgcgtctgattagctggttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcctaatgcgaatagtattaggtaatgacggtacctatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtatggtcgcaagactgaaactcaaaggaattgacggggacccgcacaagcggtggagtatgtggtttaattcgaagcaacgcgaagaaccttaccaggccttgacattgactgaaagagctagagatagctccctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggtctgggctacacacgtactacaatggaacggacagagagcagcgaacctgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtc

SEQ ID NO: 475 - DNA, 1459 bp, Artificial Sequence
  Synthetic Polynucleotide
ggcgtgcttaacacatgcaagtcgaacggaaagagatgaaagagcttgctcttttattaatttcagtggcaaacgggtgagtaacacgtaaacaacctgccttaaggatggggataacagacggaaacgactgctaataccgaatacgttctaagcatcgcatggtgcatagaagaaagggtggcctctacaagaaagctatcgccttaagaggggtttgcgactgattaggtagttggtgaggtaacggctcaccaagccgacgatcagtagccggtctgagaggatgaacggccacactggaactgagacacggtccagacccctacgggaggcagcagtggggaatcttccgcaatggacgaaagtctgacggagcaacgccgcgtgaatgaagaaggccttagggttgtaaagttctgttttctgggacgataatgacggtaccagaggaggaagccacggctaactacgtgccagcagccgcggtaatacgtaggtggcaagcgttgtccggaattattgggcgtaaagcgcgcgcaggcggtttcttaagtccatcttaaaagcgtggggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaagcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgcaatccatagaaatatggagttcttcttcggaagacgagaaaacaggtggtgcacggctgtcgtcagctcgtgtcgtgagatgttgggttaagtcccgcgacgagcgcaacccctatttcctgttaccagcacgtaaaggtggggactcaggagagaccgccgcggacaacgcggaggaaggcggggatgacgtcaagtcatcatgccccttatggcttgggctacacacgtactacaatgggtgccaacaaagagaagcgaaatcgcgagatggagcggacctcataaacgcacccccagttcagattgcaggctgcaactcgcctgcatgaagtaggaatcgctagtaatcgcgggtcagcataccgcggtgaatacgttcccgggccttgtacacaccgcccgtcacactatgagagttagagacacccgaagccggtgaggtaaccgcaagggaccagccgtctaaggtggagctgatgattggagtgaagtc

SEQ ID NO: 476 - DNA, 1399 bp, Artificial Sequence
  Synthetic Polynucleotide
gagtttgatcatggctcaggacgaacgctggcggcgtgcttaacacatgcaagtcgaacgggctctgtctggctgtgtgctgggtggggttagtggcgaacgggtgagtaatacgtgagtaacctgccctcttctttgggataagccttggaaacggggtctaatactggatattcctgtctggtcgcatggctgggtggggaaagttttttcggtgggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggaattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaatccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgcacacaccgcccgtca

SEQ ID NO: 477 - DNA, 1447 bp, Artificial Sequence
  Synthetic Polynucleotide
tcgaacgaaaagagggaactcctttggtctttccggaattgagtggcaaacgggtgagtaacacgtaaacaacctgccttcaggatggggacaacagacggaaacgactgctaataccgaataagttccaagggccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaatccctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcactttgggtggggactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccatcgggagccagccgtctaaggtaaagtcgatgat

SEQ ID NO: 478 - DNA, 1527 bp, Artificial Sequence
  Synthetic Polynucleotide
  misc_feature (913)..(915): n is a, c, g, or t
  misc_feature (917)..(938): n is a, c, g, or t
  misc_feature (947)..(947): n is a, c, g, or t
  misc_feature (950)..(950): n is a, c, g, or t
  misc_feature (952)..(960): n is a, c, g, or t
  misc_feature (962)..(967): n is a, c, g, or t
  misc_feature (974)..(975): n is a, c, g, or t
agagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggtcacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactaccaatctagagtatcggagaggaaagtggaattcctagtgcagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcnnnannnnnnnnnnnnnnnnnnnnnnggggtccgnaanannnnnnnnncnnnnnncctcccnnctcgcaccgcgaagaaccttgccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtaaccgta

SEQ ID NO: 479 - DNA, 1396 bp, Artificial Sequence
  Synthetic Polynucleotide
ggacgaacgctggcggcatgcctaacacatgcaagtcgaacggagattgatggagcttgctttattgatcttagtggcgaacgggtgagtaacgcgtaggcaacctgccctttagatggggacaacattccgaaaggggtgctaataccgaatgtgatcgtccttccgcatggaaggatgatgaaagatggcctctacgagtaagctatcgctaaaggatgggcctgcgtctgattagctagttggtgtggtaacggcgcaccaaggcgacgatcagtagccggtctgagaggatgaacggccacattgggactgagacacggcccagactcctacgggaggcagcagtggggaatcttccgcaatgggcgaaagcctgacggagcaatgccgcgtgagtgaagaagggattcgttccgtaaagctctgttgttaaggacgaatgtgcagattgcgaatagtgatctgtaatgacggtacttaacgaggaagccacggctaactacgtgccagcagccgcggtaatacgtaggtggcgagcgttgtccggaattattgggcgtaaagagcatgtaggcggttttttaagtccggagtgaaaatgcggggctcaaccccgtatggctctggatactggaagacttgagtgcaggagaggaaaggggaattcccagtgtagcggtgaaatgcgtagatattgggaggaacaccagtggcgaaggcgcctttctggactgtgtctgacgctgagatgcgaaagccagggtagcgaacgggattagataccccggtagtcctggccgtaaacgatgggtactaggtgtaggaggtatcgaccccttctgtgccggagttaacgcaataagtaccccgcctggggagtacgtccgcaaggatgaaactcaaaggaattgacgggggcccgcacaagcggtggagtatgtggtttaattcgacgcaacgcgaagaaccttaccaaggcttgacattgagtgacagctctagagatagagcgttcccttaggggacacgaaaacaggtggtgcatggctgtcgtcagctcgtgtcgtgagatgttgggttaagtcccgcaacgagcgcaacccctatcctatgttaccagcacgtaaaggtggggactcatgggagactgccaaggacaacttggaggaaggcggggatgacgtcaagtcatcatgccccttatgtcttgggctacacacgtactacaatggtcggcaacagagggaagcaaagccgcgaggcagagcaaaccccagaaacccgatctcagttcggattgcaggctgaaactcgcctgcatgaagtcggaatcgctagtaatcgcaggtcagcatactgcggtgaatacgttcccgggccttgtacacaccgc

SEQ ID NO: 480 - DNA, 1485 bp, Artificial Sequence
  Synthetic Polynucleotide
agagtttgatcatggctcaggacgaacgctggcggcgtgcttaacacatgcaagtcgaacggggtgtttatttcggtaaacaccaagtggcgaacgggtgagtaacgcgtaagcaatctaccttcaagatggggacaacattccgaaagggatgctaataccgaatgaatgtgagagcttcacatgaagcatttactaaagaaggcctctatttataagctttcgcttgaagatgagcttgcgtctgattagctagttggcgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgatgaaggtcttaggatcgtaaagttctgttgttaaggacgaaggacggatatttaaataaggtatttgtttgacggtacttaattagaaagccacggctaactacgtgccagcagccgcggtaatacgtaggcggcaagcgttgtccggaattattgggcgtaaagggagcgcaggcgggaaactaagcggattttaaaagtgcggggctcaaccccgtgatgggatccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacgggattagataccccggtagtcctagccgtaaacgatgaatactaggtgtgggaggtatcgactccttccgtgccggagttaacgcaataagtattccgcctggggagtacggccgcaaggttgaaactcaaaggaattgacgggggcccgcacaagcggtggagtatgtggtttaattcgacgcaacgcgaagaaccttaccaagacttgacattgattgaaaggccaagagattggtccctgaacttcggttcacaagaaaacaggtggtgcatggctgtcgtcagctcgtgtcgtgagatgttgggttaagtcccgcaacgagcgcaacccctgtactatgttgccagcacgtaaaggtgggaactcatagtagactgccgcggacaacgcggaggaaggcggggatgacgtcaagtcatcatgccccttacgtcttgggctacacacgtactacaatgggatgaacagaaggaagcaaagccgcgaggcagagcggatcctataaagcatctctcagttcggattgcaggctgaaactcgcctgcatgaagtcggaatcgctagtaatcgcaggtcagcatactgcggtgaatacgttcccgggccttgtacacaccgcccgtcacaccacgaaagtcattcacacccgaagccggctaagggccgcaaggtaccgaccgtcgaaggtgggg

SEQ ID NO: 481 - DNA, 1425 bp, Artificial Sequence
  Synthetic Polynucleotide
tttgttcctggctcaagacgaaacgctggcggcgtgcttaacacatgcaagttcgaacggagcgaaacgaagcttagcttttataagcttagcggcaaaacgggcgagtaacacgtagacaactctgccgacaggacggggacaacactccgaaaggaatgctaataccgaatgaagtcgagggaaggcatcttccttcgatgaaagatggcctcttttttatgctatcacctgttgatgggtctgcgtctgattagctggtaggtgaggtaacggctcacctaggcgacgatcagtagccggtctgagaggatgaacggccacattgggactgagacacggcccagactcctacgggaggcagcagtggggaaatcttccgcaatgggcgcaagcctgacggagcaaccccgcatgagtgaagaaagtcttcggatcgtaaagctctgtttgatggggacgaaacgtgcctaatgcgaatagttttaggcaatgacggtacccatcgaggaagccacggctaactacgtgccagcagccgcggtaatacgtaggtggcgagcgttttccggaatcattgggcgtaaagggagcgcaggcgggcatgtaagtctttcttaaaagtgcggggctcaaccccgtgatgggaaagaaactatatgtcttgagtacagaagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagttagagataactccctctcttcggagacaggaaaacaggtggtgcatggctgtcgtcagctcgtgtcgtgagatgttgggttaagtcccgcaacgagcgcaacccctgttctttgttgccagcatgtaaagatgggcactcaaaggagactgccgcggagaacgcggaggaaggcggggatgacgtcaagtcatcatgccccttatggtctgggctacacacgtactacaatgggacggacagagggcagcgagagagtgatcttaagcgaatctcaaaaaccgtttctcagttcggattgcaggctgcaaactcgcctgcatgaagtcggaatcgctagtaatcgcaggtcagcatactgcggtgaatacgtttcccgggtcttgtacacaccgcccgtca

SEQ ID NO: 482 - DNA, 1392 bp, Artificial Sequence
  Synthetic Polynucleotide
gacgaacgctggcggcgtgcttaacacatgcaagtcgaacgaaaggacaagaaaagcttgcttcttttggaatcgagtggcaaacgggtgaataacacgtaaacaacctgccttcaggatggggacaacagacggaaacgactgctaataccgaatacgcttggaagaccgcatgattttccaaggaaagggtggcctctacctgtaagctatcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggtctgtaagctaatatcttatggaagtgacggtacccgaatagcaagccacggctaactacgtgccagcagccgcggtaatacgtaggtggcaagcgttgtccggaattattgggcgtaaagcacgcgcaggcggctttctaagtccatcttaaaagtgcggggcttaaccccgtgatgggatggaaactggaaagctggagtatcggagaggaaagtggaattcctagtgtagcggtgaaatgcgtagagattaggaagaacaccggtggcgaaggcgactttctggacgacaactgacgctgaggcgggaaagcgtggggagcaaacaggattagataccgtggtagtccacgccgtaaacgatgaatactaggtgtaggaggtatcgaccccttctgtgcgggagctaacacaataagtattctgcttgggaagtaggatagcaagattaaaactcaaaggaattgacgggggccggcacaagcggtggagtatgtggtttaatttgatgcaacgcgaagaaccttaccaggtcttgacattgattgccattccaagaaatgggaagttgtcattagggagacgagaaaacaggtggtgcagggcggtcgtcagctggtgtcgtgagatgttgggttaagtcctgcaacgagggcaacccctattttatgttaccagcaggttatggtggggaatcatgagagaccgccggggacaacgcggaggaaggtggggatgaagtcaagttatcatgccccttatgaactggggtacacaagtagtacaatgggtgtcaacaaagagaagcgaaaccgcgaggtggagcgaacctcaaaaacacacccccagttcagattgcaggctgcaaacccgcctgcatgaagtaggaaatcgctagtaatcgcgggtcagcataccgcggtaaatacgttcccgggtct

SEQ ID NO: 483 - DNA, 1506 bp, Artificial Sequence; identical to SEQ ID NO: 205
  Synthetic Polynucleotide

SEQ ID NO: 484 - DNA, 1469 bp, Artificial Sequence
  Synthetic Polynucleotide
acgaacgctggcggcgtgcttaacacatgcaagtcgaacgagaagagatgagaagcttgcttcttattaattctagtggcaaacgggtgagtaacgcgtaagcaacctgcccttcagatggggacaacagatggaaacggctgctaataccgaatacgttcatttcgccgcatgacgggatgaagaaagggaggccttcgggctttcgctggaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagtcctgttatatgggacgaacaggacatcggttaatacccggtgtctttgacggtaccgtaagagaaagccacggctaactacgtgccagcagccgcggtaatacgtaggtggcaagcgttgtccggaattattgggcgtaaagggcgcgcaggcggcatcgcaagtcggtcttaaaagtgcggggcttaaccccgtgaggggaccgaaactgtgaagctcgagtgtcggagaggaaggcggaattcctagtgtagcagtgaaatgcgtagatattaggaggaacatcagtggcgaaagcggctttctggacgacaactgacgctgaggcgcgaaagccaggggagcaaacgggattagataccccggtagtcctggccgtaaacgatggatactgggtgtaggaggtatcgactccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgagtgaagggcgtagagatacgccgttcttcttcggaagacacgaaaacaggtggtgcacggctgtcgtcagctcgtgtcgtgagatgttgggttaagtcccgcaacgagcgcaacccttatcttcagttaccagcacgtagaggtggggactcaggagagactgccgcagacaatgcggaggaaggcggggatgacgtcaagtcatcatgcccctaatggcttgggctacacacgtactacaatggctcctaatagagggaagcaagggagcgatccggagcaaaccccaaaaacggagtcccagttcggattgcaggctgcaactcgcctgcatgaaggaggaatcgccagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggg

SEQ ID NO: 485 - DNA, 1422 bp, Artificial Sequence
  Synthetic Polynucleotide
gagtttgatcatggctcaggacgaacgctggcggcgtgcttaacacatgcaagtcgaacgaagagcgacggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaactgacgctgaggcgcgaaagccaggggagcgaacgggattggataccccggtagtcctggccgtaaccgatgggtagtacgcgtcggaggtatcgaccccttctgtgccggacttaacgcaataagtaccccgcctgaggagtacgaccgcaaggttgaaactcaaacgaattgacgggggcccgcacaagcggtggagtatgtggttgaattagacgcaacgcgaagaaccttacagaggtctcgacactgatggacagaaccagagatggttcctgttcttgcgaagcccgaaaacaggcggtgcacggttgtcgtcagcttgtgtcgtgagatggtgggttaagtcccgcaacgagcgcaacccctatcttacgttgccagcactttgcgtcggggactcatgagagactgccgcagaccatgcggaggaaggcggggatgacgtcaaatcatcatgccccttatgacctgggctacacacgtaatacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccctgcacacaccgcccgtca

SEQ ID NO: 486 - DNA, 1468 bp, Artificial Sequence
  Synthetic Polynucleotide
gcggcgtgcttaacacatgcaagtcgacccttgagcgatggaagcttgcttctgtcaatcttactggccaacgggggagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcctctgattatctagttggaggggtaacggcccaccaaggcgatgatcagtagccggtctgagaggatgaacggccacattggcaccgacacacggcccagactcctacgggaggcagcagtggggaatcttccgcaatggacgaaagtctgacagagcaacgccgcgtgagtgatgacggccttctggttgtaaagctctgttaatcgggacgaacggccttcttgcgaatagtgagaaggattgacggtaccggaatataaagccacggctaactacgtgccagcagccgcggtaatacgtaggtggcaagcgttgtccagaattattgggcgtaaagcgcgcgcaggcggatatgtcagtctgtcttaaaagttcggggcttaaccccgtgatgggatggaaactgtcaatctagagtatcggagaggaaagtggaattcctagtgtagcggtgaaatgcgtagatattaggaagaacaccagtggcgaaggcgactttctggacgaaaactgacggtgagggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcactttgggtggggactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgat

SEQ ID NO: 487 - DNA, 1472 bp, Artificial Sequence
  Synthetic Polynucleotide
cggcgtgcttaacacatgcaagtcgaacgaaaagagggaaagagcttgctctttccggaattgagtggcaaacgggtgagtaacacgtaaacaacctgccttcaggatggggacaacagacggaaacgactgctaataccgaataagttccaagggccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgagcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaaaccgcgaggaagagcaaacctcaaaaacacacccccagttcagatcgcaggctgcaacccgcctgcgtgaagcaggaatcgctagtaatcgcgggtcagcataccgcggtgaatacgttcccgggccttgtacacaccgcccgtcacaccacgaaagttggtaacacccgaagccggtgagataaccttataggagtcagctgtctaaggtggggccgatga

SEQ ID NO: 488 - DNA, 1553 bp, Artificial Sequence
  Synthetic Polynucleotide
gagagtttgatcctggctcaggacgaacgctggcggcgtgcttaacacatgcaagtcgaacgaaaagacggaaagagcttgctctttccagaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattaactggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaagggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattagaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctctgtgccggagttaacgcaatagtatcccgcctgggaagtacgatcgcaagattaaaactcaaaggaattgacgggggcccgcacaagcggtggagtatgcggtttaattcgacgcaacgcgaagaaccttaccaggtcgtgacattgatcgcgatctgcagaaatgcggagttcttcttcggaagacgagaaaacaggtggtgcacggctgtcgtcagctcgtgtcgtgagatgttgggttaagtcccgcaacgagcgcaacccctgtcctttgttgccagcgcgtaatggcgggaactcaaaggagactgccgcggagaacgcggaggaaggcggggatgacgtcaagtcatcatgccccttatgtcctgggctacacacgtactacaatgggatggacagagggaagcgaaggcgcgagccggagcggaccccacaaaccacccccagttcggattgcaggctgcaacccgcctacatgaagtcggagttgctagtaatcgcaaatcagaatgttgcggtgaatgcgttcccgggtcttgtacacaccgcccgtcacaccatgggagttaaaaatacccgaagccggtgagctaaccgcaagggagcagccgtcgaaggtagggttaatgactggggtgtagtcgtaacaaggtagccgtatcggaaggtgcggctggaacacct

SEQ ID NO: 489 - DNA, 1513 bp, Artificial Sequence
  Synthetic Polynucleotide
taggggtttgatcatggctcagattgaacgctggcggcgtgcttaacacatgcaagtcgaacgcgaaagggacttcggtcctgagtaaagtggcgcacgggtgagtaacgcgtggataatctgcccttatgattggaataacagttggaaacggctgctaataccggatacgctcaaaatgaattttttgaggaaagatggcctctgcttgcatgctatcgcataaggatgagtccgcgtcccattagcttgttggcggggtaacggcccaccaaggcatcgatgggtagccgatttgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaactacgttgtgctaatcagcagcgtactgacggtaccttcaaaggaagcaccggctaactccgtgccagcagccgcggtaatacggagggtgcaagcgttaatcggaattactgggcgtaaagcgcacgtaggctgtagtgtaagtcaggggtgaaatcccacggctcaaccgtggaactgcctttgatactgcacaacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatccacggaaccctcccgaaaaggaggggtgcccttcggggagccgtgtgacaggtgctgcatggctgtcgtcagctcgtgtcgtgagatgttgggttaagtcccgcaacgagcgcaacccctatggatagttgccagcaagtaatgttgggcactctattcagactgcccgggttaaccgggaggaaggtggggacgacgtcaagtcatcatggcccttacgcctagggctacacacgtactacaatggcacgcacaaagggaagcgagaccgcgaggtggagccaatcccaaaaaacgtgtcccagtccggattgcagtctgcaactcgactgcatgaagttggaatcgctagtaattcgagatcagcatgctcgggtgaatgcgttcccgggccttgtacacaccgcccgtcacaccacgaaagtcggttttacccgaagccggtgagccaaccagcaatggaggcagccgtctacggtagggccgatgattggggtgaagtcgtaacaaggtagcc

SEQ ID NO: 490 - DNA, 1516 bp, Artificial Sequence
  Synthetic Polynucleotide
agagtttgatcctggctcagattgaacgctggcggcgtgcttaacacatgcaagtcgaacgcgaaagggacttcggtcctgagtaaagtggcgcacgggtgagtaacgcgtggataatctgcccttatgattggaataacagttggaaacggctgctaataccggatacgctcaaaatgaactttttgaggaaagatgacctctgcttgcaagttatcgcataaggatgagtccgcgtcccattagctagttggtggggtaatggcccaccaaggcttcgatgggtagccgatttgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagagactgtgctgtgctaatcagcagtgcattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcctttgatactgcgcgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggattatgtggtttaattcgaagcaacgcgaagaaccttaccaggacttgacatcctactaacgaggtagagatacgtcaggtgcccttcggggaaagtagagacaggtggtgcatggttgtcgtcagctcgtgtcgtgagatgttgggttaagtcccgcaacgagcgcaacccctatggatagttgccagcaagtaaagttgggcactctattcagactgcccgggttaaccgggaggaaggtggggacgacgtcaagtcatcatggcccttacgcctagggctacacacgtactacaatggcgcgcacaaaggggagcgagaccgcgaggtggagccaatcccaaaaaacgcgtcccagtccggattgcagtctgcaactcgactgcatgaagttggaatcgctagtaattcgagatcagcatgctcgggtgaatgcgttcccgggccttgtacacaccgcccgtcacaccacgaaagtcggttttacccgaagccggtaagccaaccagcaatggaggcagccgtctacggtagggccgatgattggggtgaagtcgtaacaaggtaaccgtag

SEQ ID NO: 491 - DNA, 1542 bp, Artificial Sequence
  Synthetic Polynucleotide
agagtttgatcctggctcagattgaacgctggcggcgtgcttaacacatgcaagtcgtacgcgaaagggacttcggtcccgagtaaagtggcgcacgggtgagtaacacgtggataatctgcctctatgatggggataacagttggaaacgactgctaataccgaatacgctcatgatgaactttgtgaggaaaggtggcctctgcttgcaagctatcgcatagagatgagtccgcgtcccattagctagttggtggggtaacggcctaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggtcttcggatcgtaaacctctgtcagaagggaagaaactagggtgttctaatcatcatcctactgacggtaccttcaaaggaagcaccggctaactccgtgccagcagccgcggtaatacggagggtgcaagcgttaatcggaatcactgggcgtaaagcgcacgtaggctgttatgtaagtcaggggtgaaagcccacggctcaaccgtggaactgcccttgatactgcacgactcgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgccgtaaacgatggatgctagatgtcgggatgtatgtctcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatctggggaaccctcccgaaaatgaggggtgcccttcggggagccccaagacaggtgctgcatggctgtcgtcagctcgtgtcgtgagatgttgggttaagtcccgcaacgagcgcaacccctatgcatagttgccagcaagtaaagttgggcactctatgcagactgcccgggttaaccgggaggaaggtggggacgacgtcaagtcatcatggcccttacacctagggctacacacgtactacaatggcacgcacaaagggcagcgataccgtgaggtggagccaatcccaaaaaacgtgtcccagtccggattgcagtctgcaactcgactgcatgaagtcggaatcgctagtaattcgaggtcagcatactcgggtgaatgcgttcccgggccttgtacacaccgcccgtcacaccacgaaagtcggttttacccgaagccggtgagccaactagcaatagaggcagccgtctacggtagggccgatgattggggtgaagtcgtaacaaggtagccgtaggggaacctgcggctggatcacctcctt

SEQ ID NO: 492 - DNA, 1408 bp, Artificial Sequence; identical to SEQ ID NO: 118
  Synthetic Polynucleotide

SEQ ID NO: 493 - DNA, 1411 bp, Artificial Sequence
  Synthetic Polynucleotide
agagtttgatcctggctcagattgaacgctggcggcgtgcttaacacatgcaagtcgaacgcgaaagtggcttcggtcacgagtagagtggcgcacgggtgagtaacgcgtggataatctgccctcataaccgggataacagttggaaacggctgctaataccggatacgctctgaatgaacttttaggggaaagacggcctctgcttgcaagctgtcgtatgaggatgagtccgcgtcccattagctggttggcggggtaacggcccaccaaggcaacgatgggtagccgatctgagaggatgatcggccacactggaactgaaacacggtccagactcctacgggaggcagcagtggagaatattgcgcaatgggcgaaagcctgacgcagcgacgccgcgtgagggatgaaggttttcggatcgtaaacctctgtcagaagggaagaaagtgcgtggtgctaatcagccatgtattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtggaatccgtagatatctggaggaacatcagtggcgaaggcggccacctggaccggtattgacgctgaggtgcgaaagcgtggggagcaaacaggattagatcccctggtagtcccacgcggtaaacgatgtcgacttggaggttgtgcccttgaggggtggcttccggagctaacgcgttaagtcgaccgcctggggagtacggccgcaaggttaaaactcaaatgaattgacgggggcccgcacaagcggtggagtatgtggtttaattcgatgcaacgcgaagaaccttacctgggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacccagggctacacacgtactacaatggcgcgcacaaaggggagcaagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgcactcaaagcccgtca

SEQ ID NO: 494 - DNA, 1473 bp, Artificial Sequence
  Synthetic Polynucleotide
  misc_feature (60)..(60): n is a, c, g, or t
  misc_feature (243)..(243): n is a, c, g, or t
attgaacgctggcggcgtgcttaacacatgcaagtcgaacgcgaaagcggcttcggccgngagtagagtggcgcacgggtgagtaacgcgtggacaatctgccctcatgaccgggataacagttggaaacgactgctaataccggatacgctctggatgaacatttggaggaaagacggcctctgcatgcaagctgtcgtatgaggatgagtccgcgtcccattagcttgttggtggggtaanggcctaccaaggcgacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaagtgcgtggtgctaatcagccgcgtattgacggtaccttcaaaggaagcaccggctaactccgtgccagcagccgcggtaatacggagggtgcgagcgttaatcggaattactgggcgtaaagcgcacgtaggctgttgtgtaagtcaggggtgaaatcccacggctcaaccgtggaactgcccttgatactgcatgactggaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctgggtttgacatctggggaatcctcccgaaaaggaggagtgcccttcggggagccccaagacaggtgctgcatggctgtcgtcagctcgtgtcgtgagatgttgggttaagtcccgcaacgagcgcaacccctatgcatagttgccagcgagtgaagtcgggcactctatgcagactgcccgggttaaccgggaggaaggtggggacgacgtcaagtcatcatggcccttacacccagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaaccagtaatggaggcatccgtctacggtagggccgatgattggggtga

SEQ ID NO: 495 - DNA, 1512 bp, Artificial Sequence
  Synthetic Polynucleotide
agagtttgatcctggctcagattgaacgctggcggcgtgcttaacacatgcaagtcgtgcgagaaagggggcttcggtccctgagtagagcggcgcacgggtgagtaacgcgtggattatctccctcattgtttgggataacggcgggaaactgccgctaataccggatacgctccaatttcggttgggggaaaggcggcctctgcttgcaagctgtcgcaatgagatgagtccgcgtcccattagcttgttggtggggtaatggcccaccaaggcaacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcaggaaggaagaacctctcaaggctgaacaagccttgggactgacggtacttccagaggaagcaccggctaactccgtgccagcagccgcggtaatacggagggtgcaagcgttaatcggaattactgggcgtaaagcgcacgtaggctgctttgtaagtcaggggtgaaatcccacggctcaaccgtggaactgcctttgatactgcttagcttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatccacggaacctctccgaaaagagagggtgcccttcggggagccgtgagacaggtgctgcatggctgtcgtcagctcgtgtcgtgagatgttgggttaagtcccgcaacgagcgcaacccctatgaatagttgccagcaagtaaagttgggcactctattcagactgcccgggttaaccgggaggaaggtggggacgacgtcaagtcatcatggcccttacgcctagggctacacacgtactacaatggcgcgcacaaagggaagcgagaccgcgaggtggagccaatcccaaaaaacgcgtcccagtccggattgcagtctgcaactcgactgcatgaagttggaatcgctagtaatcgtggatcagcatgccacggtgaatacgttcccgggccttgtacacaccgcccgtcacaccatgggagttggttttacccgaagccggtgagctaaccgcaaggaggcagccgaccacggtaaggtcagcgactggggtgaagtcgtaacaaggtaaccgt

SEQ ID NO: 496 - DNA, 1387 bp, Artificial Sequence; identical to SEQ ID NO: 17
  Synthetic Polynucleotide

SEQ ID NO: 497 - DNA, 1513 bp, Artificial Sequence
  Synthetic Polynucleotide
agagtttgatcatggctcagattgaacgctggcggcgtgcttaacacatgcaagtcgaacgcgaaagtggcttcggccgcgagtagagtggcgcacgggtgagtaacgcgtggataatctgcctctgcaatcggaataacgactggaaacggtcgctaataccggatacgcttaagttttacctcttaaggaaagatgacctctatttataagttatcgtgcagagatgagtccgcgtcccattagcttgttggcggggtaacggcccaccaaggcgacgatgggtagccggtttaagaggatgatcggccacattggaactgaaacacggtccaaactcctacgggaggcagcagtggggaatattgcgcaatgggcgaaagcctgacgcagcgacgccgcgtgagggatgaaggtcttcggatcgtaaacctctgtcagaagggaaaaatgtacagtgctccaatcaacactgtattgatggtaccttcagaggaagcaccggctaactccgtgccagcagccgcggtaatacggagggtgcaagcgttaatcggaattactgggcgtaaagcgcgcgtaggttgttttgtaagtcagaggtgtaatcccacggcttaaccgtggaactgcctttgatactgcgtaacttggatccgggagaggacagcggaattccaggtgtaggagtgaaatccgtagatatctggaagaacatcagtggcgaaggcggctgtctggaccggtattgacgctgaggcgcgaaagcgtgggtagcaaacaggattagataccctggtagtccacgctgtaaacgatggatgctggatgtcggggcgcaagcttcggtgtcgtagttaacgcgataagcatcccgcctggggactacggtcgcaaggctgaaactcaaagaaattgacgggggcccgcacaagcggtggagtatgtggtttaattcgatgcaacgcgaagaaccttacctgggtttgacatccacggaatttctgtgaaagcaggaagtgcccgcaagggagccgtgagacaggtgctgcatggctgtcgtcagctcgtgtcgtgagatgttgggttaagtcccgcaacgagcgcaacccctatgcacagttgccagcaggtgaagctgggcactctgtgcagaccgcccgggttaaccgggaggaaggtggggatgacgtcaagtcatcatggcccttacacccagggcgacacacgtactacaatggcacatacaaagggcagcgaaaccgcgaggtcaagccaatcccaaaaactgtgtcccagtccggataggagtctgcaacccgactccttgaagttggaatcgctagtaattccggatcagcatgccggggtgaatgcgttcccgggccttgtacacaccgcccgtcacaccacgaaagtcggttttacccgaaaccggtgagtcaactagcaatagagacagccgtctacggtaggaccgatgattggggtgaagtcgtaacaaggtaaccgt

SEQ ID NO: 498 - DNA, 1380 bp, Artificial Sequence
  Synthetic Polynucleotide
gacgaactctggcggcgcgcctaacacatgcaagtcgaacggagcttagagagcttgctttttaagcttagtggcgaacgggtgagtaacgcgtggataatctacccttaagatggggataacggctggaaacggtcgctaataccgaatacgctcccgattttatcggtggggggaaagatggcctctgcttgcaagctatcgcttaaggatgagtccgcgtcccattagctagttggcggggtaacggcccaccaaggcgacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcttggtaagtcaggggtgaaatcccacagcccaactgtggaactgcctttgatactgccaggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggacgacgtcaagtcatcatggcccttacgcctggggctacacacgtactacaatggcgcgcacaaagggtagcgagaccgcgaggtggagccaatcccaaaaaacgcgtcccagtccggattggagtctgcaactcgactccatgaagtcggaatcgctagtaattcgagatcagcatgctcgggtgaatgcgttcccgggccttgcac

SEQ ID NO: 499 - DNA, 1375 bp, Artificial Sequence
  Synthetic Polynucleotide
attgaacgctggcggcgtgcttaacacatgcaagtcgaacgtgaaagtccttcgggacgagtaaagtggcgcacgggtgagtaacgcgtggataatctacccttaagatggggataacggctggaaacggtcgctaataccgaatacgctcccgattttatcattggggggaaagatggcctctgcttgcaagctatcgcttaaggatgagtccgcgtcccattagctagttggcggggtaacggcccaccaaggcaacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcctggtaagtcaggggtgaaatcccacagcccaactgtggaactgcctttgatactgccaggcttgagtaccggagagggtggcggaattccaggtgtaggagtgaaatccgtagatatctggaggaacaccggtggcggaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggacgacgtcaagtcatcatggcccttacgcctggggctacacacgtactacaatggcgcgcacaaaagggtagcgagaccgcgaggtggagccaaatcccaaaaaaacggcgtcccagtccggatggagttctgcaaactggattccagaaagtgggaatggctagtaattggaaatcagcatgctggggggaaggggttcccgggcct

SEQ ID NO: 500 - DNA, 1392 bp, Artificial Sequence
  Synthetic Polynucleotide
cctggctcacattgaacgctggcggcgtgcttaacacatgcaagtcgaacggaaagtccttcgggacgagtaaagtggcgcacgggtgagtaacgcgtggataatctaccttcaagacggggataacggctggaaacggtcgctaataccggatacgctcccgattttatcgttggggggaaagatggcctctgcttgaagctatcgcttggggatgagtccgcgtcccattagctagttggtggggtaacggcccaccaaggcaacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttttcggatcgtaaacctctgtcaggggggaagaaaacccttcgtgtgaataatgcgaaggcttgacggtacccccaaaggaagcaccggctaactccgtgccagcagccgcggtaatacggagggtgcaagcgttaatcggaatcactgggcgtaaagcgcacgtaggcggcccggtaagtcaggggtgaaatcccacagcccaactgtggaactgcccttgatactgcctggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggagccttcccgaaacggaagggtgcccctcggggagccctaagacaggtgctgcatggctgtcgtcagctcgtgccgtgaggtgttgggttaagtcccgcaacgagcgcaacccctatcttcagttgccatcaggtaaggctgggcactctggagagaccgccccggtcaacggggaggaaggtggggacgacgtcaagtcatcatggcccttacgcctggggctacacacgtactacaatggcgcgcacaaagggtagcgagaccgcgaggtggagccaatcccaaaaaacgcgtcccagtccggattggagtctgcaactcgactccatgaagtcggaatcgctagtaattcgagatcagcatgctcgggtgaatgcgttcccgggccttgtacacaccgccc

SEQ ID NO: 501 - DNA, 1491 bp, Artificial Sequence
  Synthetic Polynucleotide
attgaacgctggcggcgtgcttaacacatgcaagtcgaacgtgaagtccttcgggatgagtaaagtggcgcacgggtgagtaacgcgtggataatctacccttaagatggggataacggctggaaacggtcgctaataccgaatacgctcccgattttatcgttggggggaaagatggcctctgcttgcaagctatcgcttaaggatgagtccgcgtcccattagctagttggcggggtaacggcccaccaaggcgacgatgggtagccggtctgagaggatgaccggccacactggaactggaacacggtccagactcctacgggaggcagcagtggggaatattgcgcaatgggcgaaagcctgacgcagcgacgccgcgtgagggatgaaggtctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcccggtaagtcaggggtgaaatcccacagcccaactgtggaacttccttgatactgccgggcttgagtaccggagagggtggcggaattccaggtgtaggagtgaaatccgtagatatctggaagaacaccggtggcgaaggcggccacctggacggtaactgacgccgaggtgccaaagcgtgggtagcaaacaggattagataccctggtagtccccgccgtaaacgatgggtgctgggtgctgggatgtatgtctcggtgccgtagctaacgcgataagcacgccgcgtggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccatcaggtgaagctgggcactctggagagaccgccccggtcaacggggaggaaggtggggacgacgtcaagtcatcatggcccttacgcctggggctacacacgtactacaatggcgcgcacaaagggcagcgagaccgtgaggtggagccaatcccaaaaaacgcgtcccagtccggattggagtctgcaactcgactccatgaagtcggaatcgctagtaattcgagatcagcatgctcgggtgaatgcgttcccgggccttgtacacaccgcccgtcacaccacgaaagtcggttttacccgaagccggtgggctaactcgcaagaggagcagccgtctacggtagggccgatgattggggagaagtcgtaacaaggtagccgt

SEQ ID NO: 502 - DNA, 1541 bp, Artificial Sequence
  Synthetic Polynucleotide
gagtttgattctggctcagattgaacgctggcggcgtgcttaacacatgcaagtcgaacgtgaaaggggcttcggccccgagtaaagtggcgcacgggtgagtaacgcgtggacaatctgcccttatgagtgggataacagttggaaacggctgctaataccgcatacgctcaggaatgactttttgaggaaaggcggcctctgcttgcaagctgtcgcataaggatgagtccgcgtcccattagcttgttggtggggtaacggcctaccaaggcaacgatgggtagccgatttgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcggaagggaagaaggtgcactctgccaatcaggggtgtattgacggtaccttcaaaggaagcaccggctaactccgtgccagcagccgcggtaatacggagggtgcgagcgttaatcggaattactgggcgtaaagcgcacgtaggctgtcatgtaagtcaggggtgaaatcccacggctcaaccgtggaactgcctttgatactgcgtgacttgaatccgggagagggtggcggaattccaggtgtaggagtgatatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttgacgcgttaagcatcccgcctggggagtacggtcgcaaggctgaaactcaaagaaattgacgggggcccgcacaagcggtggagtatgtggtttaattcgatgcaacgcgaagaaccttacctgggtttgacatccacggaaccctccggaaatggaggggtgcccttcggggagccgtgagacaggtgctgcatggccgtcgtcagctcgtgtcgtgagatgttgggttaagtcccgcaacgagcgcaacccctatgcatagttgccatcaagtgaagttgggcactctatgcagactgcccgggttaaccgggaggaaggtggggacgacgtcaagtcatcatggcccttacacccagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgggccaaccagcaatggaggcagccgtctacggtagggctgatgattggggtgaagtcgtaacaaggtagccgtaggggaacctgcggctggatcacctcctt

SEQ ID NO: 503 - DNA, 1373 bp, Artificial Sequence
  Synthetic Polynucleotide
  misc_feature (123)..(123): n is a, c, g, or t
  misc_feature (130)..(130): n is a, c, g, or t
  misc_feature (135)..(135): n is a, c, g, or t
  misc_feature (157)..(157): n is a, c, g, or t
  misc_feature (159)..(159): n is a, c, g, or t
  misc_feature (176)..(176): n is a, c, g, or t
  misc_feature (183)..(183): n is a, c, g, or t
  misc_feature (201)..(201): n is a, c, g, or t
  misc_feature (218)..(219): n is a, c, g, or t
  misc_feature (241)..(241): n is a, c, g, or t
  misc_feature (271)..(271): n is a, c, g, or t
  misc_feature (1182)..(1182): n is a, c, g, or t
  misc_feature (1350)..(1350): n is a, c, g, or t
  misc_feature (1371)..(1371): n is a, c, g, or t
agtcgtgcgagaaagggacttcggtcctgagtagagcggcgcacgggtgagtaacgcgtgggtgatctcccttggtgatcgggataacagcgggaaactgctgctaataccggataatcttcntgtttanttcanggggtaaaggtggcctctgctntncaagctaccacatcaanatgagcncgcgtctcatctagctanttggtagggtaatggcnnaccaaggctacgatgagtagcnggtctgagaggatgaccagccacactgggnctggaacacggcccagactcctacgggaggcagcagtggggcatattgcgcaatgggcgaaagcctgacgcagcgacgcctcgtgagggatgaaggtcttcggatcgtaaacctctgtcaagagggaagaaacctttggattcgaacagggtctaaagctgacggtacctctaaaggaagcaccggctaactccgtgccagcagccgcggtaatacggagggtgcaagcgttaatcggaatcactgggcgtaaagcgctcgtaggcggtttggtcagtcagacgtgaaatcccgcagctcaactgcggaactgcgtttgatactgccagacttgagtgtcggagagggtggcggaattccgggtgtaggagtgaaatccgtagatatccggaggaacaccagtggcgaaggcggccacctggacgacaactgacgctgaggagcgaaagcgtgggtagcaaacaggattagataccctggtagtccacgcggtaaacgatggatgctgggtgtcgggggtttaccctcggtgccgcagttaacgcgttaagcatcccgcctggggagtacggtcgcaaggctgaaactcaaaggaattgacgggggcccgcacaagcggtggagtatgtggtttaattcgatgcaacgcgaagaaccttacctaggcttgacatccttggaatcctcccgaaaaggaggagtgcccttcggggagccaagagacaggtgctgcatggctgtcgtcagctcgtgccgtgaggtgttgggttaagtcccgcaacgagcgcaacccctattgccagttgccagcaggtaatgctgggcactctggtgagactgcccgggtcaaccgggaggaaggtggggatgacgtcaagtcatcatggcccttacgcctagggctacacacntactacaatggtgggtacaaagggcagcaacgccgcgaggcttagccaatcccaaaaaacccatctcagtccggattgcagtctgcaactcgactgcatgaagctggaatcgctagtaatcccggatcagcatgccggggtgaatacgttcccgggccttgtacacantgcccgtacaccacgaaagcngg

SEQ ID NO: 504 - DNA, 1483 bp, Artificial Sequence
  Synthetic Polynucleotide
attgaacgctggcggcgtgcttaacacatgcaagtcgaacgcgaaagggacttcggtcctgagtaaagtggcgcacgggtgagtaacgcgtggataatctgcccttatgatcgggataacagttggaaacggctgctaataccggatacgctcaaaatgaactttttgaggaaagatggcctctgcttgcatgctatcgcgtaaggatgagtccgcgtcccattagcttgttggcggggtaacggcccaccaaggcaacgatgggtagccgatttgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaactacattgtgctaatcagcagtgtactgacggtaccttcaaaggaagcaccggctaactccgtgccagcagccgcggtaatacggagggtgcaagcgttaatcggaattactgggcgtaaagcgcacgtaggctgtagtgtaagtcaggggtgaaatcccacggctcaaccgtggaactgcctttgatactgcacaacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgcggtaaacgatggatgctgggtgtcgggggtttaccttcggtgccgcagttaacgcgttaagcatcccgcctggggagtacggtcgcaaggctgaaactcaaaggaattgacgggggcccgcacaagcggtggagtatgtggtttaattcgatgcaacgcgaagaaccttacctaggcttgacatccttggaatccctccgaaaagggggagtgcccttcggggagccaagagacaggtgctgcatggctgtcgtcagctcgtgccgtgaggtgttgggttaagtcccgcaacgagcgcaacccctattgccagttgccagcaggtaaagctgggcactctggtgagactgcccgggtcaaccgggaggaaggtggggatgacgtcaagtcatcatggctcttacgcctagggctacacacgtactacaatggtgggtacaaagggccgcaaagccgcgaggccaagccaatcccagaaaacccatctcagtccggattgcagtctgcaactcgactgcatgaagctggaatcgctagtaatcccggatcagcatgccggggtgaatacgttcccgggccttgtacacaccgcccgtcacaccacgaaagctggatttacccgaagccggcggactaaccgcaaggaggtagtcgtcgacggtaggtctggtgattggggtgaagtcgtaacaag

SEQ ID NO: 505 - DNA, 1397 bp, Artificial Sequence
  Synthetic Polynucleotide
agaggttgattctggctcagattgaacgctggcggcgtgcttaacacatgcaagtcgaacgtgaaagtccttcgggacgagtaaagtggcgcacgggtgagtaacgcgtggataatctacccttaagatggggataacggctggaaacggtcgctaataccgaatacgctcccgattttatcattggggggaaagatggcctctgcttgcaagctatcgcttaaggatgagtccgcgtcccattagctagttggcggggtaacggcccaccaaggcaacgatgggtagccggtctgagaggatgaccggccacactggaattggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcagcttggtaagtcaggggtgaaaccccacagcccaactgaggaactgcctttgatactgccaggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatggggggggggtggctgggaatgtatttttcggtgctgtagctaacgcgataagcaccccgccgcgggagtacggtcgcaaggctgaaactcaaagaaaatgacgggggcccgcacaagcgccggagtatgtggtttaatttgatgcaacgcgaagaaccttacccaggcttgacatctagggaacccttctgaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggaggacgtcaagtcatcatggcccttacgcctggggctacacacgtactacaatggcgcgcacaaagggtagcgagaccgcgaggtggagccaatcccaaaaaacgcgtcctagtccggattggagtctgcaactcgactccatgaggtcggaatcgctagtaattcgagatcagcatgctcgggtgaatgagttcccgggccttgcac

SEQ ID NO: 506 - DNA, 1439 bp, Artificial Sequence
  Synthetic Polynucleotide
tagaggttgatcctggctcagattgaacgctggcggcgtgcttaacacatgcaagtcgaacgcgaaagtggcttcggtcacgagtagagtggcgcacgggtgagtaacgcgtggataatctgccctcataaccgggataacagttggaaacggctgctaataccggatacgctctgaatgaacttttaggggaaagacggcctctgcttgcaagctgtcgtatgaggatgagtccgcgtcccattagctggttggcggggtaacggcccaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaagtgcgtggtgctaatcagccatgtattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctgggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacccagggctacacacgtactacaatggcgcgcacaaaggggagcaagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccgg

SEQ ID NO: 507 - DNA, 1515 bp, Artificial Sequence
  Synthetic Polynucleotide
agagtttgatcctggctcagattgaacgctggcggcgtgcttaacacatgcaagtcgaacgtgaacggggcttcggcccttagtaaagtggcgcacgggtgagtaacacgtggataatctgcccttatgatcgggataacagtcggaaacggctgctaataccggatacgctcaaaatgaactttttgaggaaaggtgacctctgcttgcaagttactgcatgaagatgagtccgcggcccattagctagttggtagggtaacggcctaccaaggcaacgatgggtagccgatttgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaaccgcaccgtgctaatcagcggtgcattgacggtaccttcaaaggaagcaccggctaactccgtgccagcagccgcggtaatacggagggtgcaagcgttaatcggaattactgggcgtaaagcgcacgtaggctgctttgtaagtcaggggtgaaatcccacggctcaaccgtggaactgcctttgatactgcttagcttgaatccgggagagggtggcggaattccaggtgtagggagtgaaatccgtagatatctgggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatccacggaacctctccgaaaagagagggtgcccttcggggagccgtgagacaggtgctgcatggctgccgtcagctcgtgtcgtgagatgttgggttaagtcccgcaacgagcgcaacccctatgaatagttgccagcaagtaaagttgggcactctattcagactgcccgggttaaccgggaggaaggtggggacgacgtcaagtcatcatggcccttacgcctagggctacacacgtactacaatggcgcgcacaaagggaagcgagaccgcgaggtggagccaatcccaaaaaacgcgtcccagtccggattgcagtctgcaactcgactgcatgaagttggaatcgctagtaattcgagatcagcatgctcgggtgaatgcgttcccgggccttgtacacaccgcccgtcacaccacgaaagtcggttttacccgaagtcggtgagccaaccagcaatgggggcagccgcctacggtagggctgatgattggggtgaagtcgtaacaaggtaaccgt

SEQ ID NO: 508 - DNA, 1384 bp, Artificial Sequence; identical to SEQ ID NO: 174
  Synthetic Polynucleotide

SEQ ID NO: 509 - DNA, 1413 bp, Artificial Sequence; identical to SEQ ID NO: 135
  Synthetic Polynucleotide

SEQ ID NO: 510 - DNA, 1411 bp, Artificial Sequence; identical to SEQ ID NO: 162
  Synthetic Polynucleotide

SEQ ID NO: 511 - DNA, 1405 bp, Artificial Sequence; identical to SEQ ID NO: 129
  Synthetic Polynucleotide

SEQ ID NO: 512 - DNA, 1405 bp, Artificial Sequence; identical to SEQ ID NO: 202
  Synthetic Polynucleotide

SEQ ID NO: 513 - DNA, 1520 bp, Artificial Sequence; identical to SEQ ID NO: 283
  Synthetic Polynucleotide

SEQ ID NO: 514 - DNA, 1411 bp, Artificial Sequence; identical to SEQ ID NO: 126
  Synthetic Polynucleotide

SEQ ID NO: 515 - DNA, 1397 bp, Artificial Sequence; identical to SEQ ID NO: 193
  Synthetic Polynucleotide

SEQ ID NO: 516 - DNA, 1493 bp, Artificial Sequence; identical to SEQ ID NO: 19
  Synthetic Polynucleotide

SEQ ID NO: 517 - DNA, 1465 bp, Artificial Sequence; identical to SEQ ID NO: 219
  Synthetic Polynucleotide

SEQ ID NO: 518 - DNA, 1448 bp, Artificial Sequence; identical to SEQ ID NO: 120
  Synthetic Polynucleotide

SEQ ID NO: 519 - DNA, 1399 bp, Artificial Sequence; identical to SEQ ID NO: 386
  Synthetic Polynucleotide

SEQ ID NO: 520 - DNA, 1487 bp, Artificial Sequence; identical to SEQ ID NO: 247
  Synthetic Polynucleotide

SEQ ID NO: 521 - DNA, 1407 bp, Artificial Sequence; identical to SEQ ID NO: 127
  Synthetic Polynucleotide

SEQ ID NO: 522 - DNA, 1491 bp, Artificial Sequence; identical to SEQ ID NO: 197
  Synthetic Polynucleotide

SEQ ID NO: 523 - DNA, 1483 bp, Artificial Sequence; identical to SEQ ID NO: 418
  Synthetic Polynucleotide

SEQ ID NO: 524 - DNA, 1410 bp, Artificial Sequence; identical to SEQ ID NO: 128
  Synthetic Polynucleotide

SEQ ID NO: 525 - DNA, 1451 bp, Artificial Sequence; identical to SEQ ID NO: 252
  Synthetic Polynucleotide

SEQ ID NO: 526 - DNA, 1407 bp, Artificial Sequence; identical to SEQ ID NO: 145
  Synthetic Polynucleotide

SEQ ID NO: 527 - DNA, 1474 bp, Artificial Sequence; identical to SEQ ID NO: 296
  Synthetic Polynucleotide

SEQ ID NO: 528 - DNA, 1511 bp, Artificial Sequence; identical to SEQ ID NO: 204
  Synthetic Polynucleotide

SEQ ID NO: 529 - DNA, 1463 bp, Artificial Sequence; identical to SEQ ID NO: 241
  Synthetic Polynucleotide

SEQ ID NO: 530 - DNA, 1409 bp, Artificial Sequence; identical to SEQ ID NO: 37
  Synthetic Polynucleotide

SEQ ID NO: 531 - DNA, 1405 bp, Artificial Sequence; identical to SEQ ID NO: 36
  Synthetic Polynucleotide

SEQ ID NO: 532 - DNA, 1425 bp, Artificial Sequence; identical to SEQ ID NO: 278
  Synthetic Polynucleotide

SEQ ID NO: 533 - DNA, 1365 bp, Artificial Sequence; identical to SEQ ID NO: 269
  Synthetic Polynucleotide

SEQ ID NO: 534 - DNA, 1396 bp, Artificial Sequence; identical to SEQ ID NO: 479
  Synthetic Polynucleotide

SEQ ID NO: 535 - DNA, 1506 bp, Artificial Sequence; identical to SEQ ID NO: 205
  Synthetic Polynucleotide

SEQ ID NO: 536 - DNA, 1354 bp, Artificial Sequence; identical to SEQ ID NO: 161
  Synthetic Polynucleotide

SEQ ID NO: 537 - DNA, 1369 bp, Artificial Sequence; identical to SEQ ID NO: 180
  Synthetic Polynucleotide

SEQ ID NO: 538 - DNA, 1391 bp, Artificial Sequence; identical to SEQ ID NO: 73
  Synthetic Polynucleotide

SEQ ID NO: 539 - DNA, 1353 bp, Artificial Sequence; identical to SEQ ID NO: 140
  Synthetic Polynucleotide

SEQ ID NO: 540 - DNA, 1356 bp, Artificial Sequence; identical to SEQ ID NO: 149
  Synthetic Polynucleotide

SEQ ID NO: 541 - DNA, 1494 bp, Artificial Sequence; identical to SEQ ID NO: 102
  Synthetic Polynucleotide

SEQ ID NO: 542 - DNA, 1363 bp, Artificial Sequence
  Synthetic Polynucleotide
gatgaacgctggcggcgtgcttaacacatgcaaatcgaacgaaagcatttaagacggtatttctttcgggaagaagacttttatgtactgagtggcggtacgggttgagtaacgcgtgggtaacctgcctcacacagggggtatagcagtttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgcccggtcagtaatgtgaccttttcttcggaacaagagtgacaggtggtgcatggttgtcgtcagctcgtgtcgtgagatgttgggttaagtcccgcaacgagcgcaacccctattcttagtagccagcatataaggtgggcactctaggaagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtct

SEQ ID NO: 543 - DNA, 1392 bp, Artificial Sequence; identical to SEQ ID NO: 91
  Synthetic Polynucleotide

SEQ ID NO: 544 - DNA, 1339 bp, Artificial Sequence; identical to SEQ ID NO: 150
  Synthetic Polynucleotide

SEQ ID NO: 545 - DNA, 1389 bp, Artificial Sequence
  Synthetic Polynucleotide
agagtttgatcctggctcaggatgaacgctggcggcgtgcttaacacatgcaagtcgaacgaagcatttgcgacagattttttcggaatgaagttgcttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaggcaagacagtgatgtggagcaaacccctaaaaacattctcagttcagattgcaggctgcaacccgcctgcatgaagatggaattgctagtaatcgcagatcagcatgctgcggtgaatacgttcccgggtcttgcactcaccgcccgtca

SEQ ID NO: 546 - DNA, 1345 bp, Artificial Sequence; identical to SEQ ID NO: 134
  Synthetic Polynucleotide

SEQ ID NO: 547 - DNA, 1359 bp, Artificial Sequence; identical to SEQ ID NO: 178
  Synthetic Polynucleotide

SEQ ID NO: 548 - DNA, 1394 bp, Artificial Sequence; identical to SEQ ID NO: 133
  Synthetic Polynucleotide

SEQ ID NO: 549 - DNA, 1356 bp, Artificial Sequence; identical to SEQ ID NO: 157
  Synthetic Polynucleotide

SEQ ID NO: 550 - DNA, 1446 bp, Artificial Sequence; identical to SEQ ID NO: 251
  Synthetic Polynucleotide

SEQ ID NO: 551 - DNA, 1454 bp, Artificial Sequence; identical to SEQ ID NO: 254
  Synthetic Polynucleotide

SEQ ID NO: 552 - DNA, 1453 bp, Artificial Sequence; identical to SEQ ID NO: 10
  Synthetic Polynucleotide

SEQ ID NO: 553 - DNA, 1356 bp, Artificial Sequence; identical to SEQ ID NO: 160
  Synthetic Polynucleotide

SEQ ID NO: 554 - DNA, 1438 bp, Artificial Sequence; identical to SEQ ID NO: 228
  Synthetic Polynucleotide

SEQ ID NO: 555 - DNA, 1392 bp, Artificial Sequence; identical to SEQ ID NO: 48
  Synthetic Polynucleotide

SEQ ID NO: 556 - DNA, 1447 bp, Artificial Sequence; identical to SEQ ID NO: 257
  Synthetic Polynucleotide

SEQ ID NO: 557 - DNA, 1355 bp, Artificial Sequence; identical to SEQ ID NO: 163
  Synthetic Polynucleotide

SEQ ID NO: 558 - DNA, 1460 bp, Artificial Sequence; identical to SEQ ID NO: 221
  Synthetic Polynucleotide

SEQ ID NO: 559 - DNA, 1394 bp, Artificial Sequence; identical to SEQ ID NO: 87
  Synthetic Polynucleotide

SEQ ID NO: 560 - DNA, 1353 bp, Artificial Sequence; identical to SEQ ID NO: 138
  Synthetic Polynucleotide

SEQ ID NO: 561 - DNA, 1354 bp, Artificial Sequence; identical to SEQ ID NO: 167
  Synthetic Polynucleotide

SEQ ID NO: 562 - DNA, 1389 bp, Artificial Sequence; identical to SEQ ID NO: 92
  Synthetic Polynucleotide

SEQ ID NO: 563 - DNA, 1392 bp, Artificial Sequence; identical to SEQ ID NO: 67
  Synthetic Polynucleotide

SEQ ID NO: 564 - DNA, 1385 bp, Artificial Sequence; identical to SEQ ID NO: 80
  Synthetic Polynucleotide

SEQ ID NO: 565 - DNA, 1497 bp, Artificial Sequence; identical to SEQ ID NO: 101
  Synthetic Polynucleotide

SEQ ID NO: 566 - DNA, 1450 bp, Artificial Sequence; identical to SEQ ID NO: 237
  Synthetic Polynucleotide

SEQ ID NO: 567 - DNA, 1393 bp, Artificial Sequence; identical to SEQ ID NO: 53
  Synthetic Polynucleotide

SEQ ID NO: 568 - DNA, 1391 bp, Artificial Sequence; identical to SEQ ID NO: 40
  Synthetic Polynucleotide

SEQ ID NO: 569 - DNA, 1389 bp, Artificial Sequence
  Synthetic Polynucleotide
agagtttgatcctggctcaggatgaacgctggcggcgtgcttaacacatgcaagtcgaacgaagcaccatattagattttcttcgggaatgaagatatggtgactgagtggcggacgggtgagtaacgcgtgggtaacctgcctcatacagggggatagcagttggaaacgactggtaataccgcataagcgcacggtatcgcatgatacagtgtgaaaaactccggtggtatgagatggacccgcgtctgattagctagttggtaaggtaacggcttaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagttattcgtaatgtaaagctctatcagcagggaagatagtgacggtacctgactaagaagctccggctaaatacgtgccagcagccgcggtaatacgtatggagcaagcgttatccggatttactgggtgtaaagggagtgtaggtggctgtgcaagtcagaagtgaaagcccggggctcaaccccgggactgcttttgaaactgtatagctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcgtatagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacagttctttaatcggaacctttcttcggaacagtggagacaggtggtgcatggttgtcgtcagctcgtgtcgtgagatgttgggttaagtcccgcaacgagcgcaacccttatccttagtagccagcagtaagatgggcactctagggagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaataagttcccgggtcttgcacacaccgccc

SEQ ID NO: 570 - DNA, 1378 bp, Artificial Sequence; identical to SEQ ID NO: 212
  Synthetic Polynucleotide

SEQ ID NO: 571 - DNA, 1498 bp, Artificial Sequence
  Synthetic Polynucleotide
agagtttgattatggctcaggatgaacgctggcggcgtgcttaacacatgcaagtcgaacgaagcactttatttgattttcttcgggaatgattatttagtgactgagtggcggacgggtgagtaacgcgtgggtaacctgcctcatacagggggatagcagttggaaacgactggtaataccgcataagcgcacaggaccgcatggtcgggtgtgaaaaactccggtggtatgagatggacccgcgtctgattagctagttggtggggtaacggctcaccaaggcgacgatcagtagccggcctgagagggtgaacggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcgktaatacgtatggagcaagcgttatccggatttactgggtgtaaagggagtgtaggtggcsatacaagtcagaagtgaaagcccggggctcaaccccgggactgcttttgaaactgtaaggcttgagtgcaggaggggtgagtggaattcctagtgtagcggtgaaatgcgtagatattaggaggaacaccagtggcgaaggcggctcaccggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctgggggagtacgttcgcaagaatgaaactcaaaggaattgacgggggacccgcacaagcggtgggagcatgtgggtttaattcgaagcaacgcgaagaaccttaccaagtcttgacatcctcttgaccggtcagtaatgtggsctttccttcggacaagagagacaggtggtgcatggttgtcgtcagctcgtgtcgtgagatgttgggttaagtcccgcaacgagcgcaacccttatccttagtagccagcagtaagatgggcactctagggagactgccagggataacctggaggaaggtggggatgacgtcaaatcatcatgccccttatgacttgggctacacacgtgctacaatggcgtaaacagagtgaagcgaagtcgtgaggccgagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgcaagaaggagccgccgaaggcaggtttgataactggggtgaagtcgtaacaaggtaaccgta

SEQ ID NO: 572 - DNA, 1394 bp, Artificial Sequence; identical to SEQ ID NO: 90
  Synthetic Polynucleotide

SEQ ID NO: 573 - DNA, 1463 bp, Artificial Sequence; identical to SEQ ID NO: 293
  Synthetic Polynucleotide

SEQ ID NO: 574 - DNA, 1384 bp, Artificial Sequence; identical to SEQ ID NO: 146
  Synthetic Polynucleotide

SEQ ID NO: 575 - DNA, 1449 bp, Artificial Sequence; identical to SEQ ID NO: 302
  Synthetic Polynucleotide
  misc_feature (724)..(724): n is a, c, g, or t

SEQ ID NO: 576 - DNA, 1385 bp, Artificial Sequence; identical to SEQ ID NO: 81
  Synthetic Polynucleotide

SEQ ID NO: 577 - DNA, 1497 bp, Artificial Sequence; identical to SEQ ID NO: 99
  Synthetic Polynucleotide

SEQ ID NO: 578 - DNA, 1392 bp, Artificial Sequence; identical to SEQ ID NO: 49
  Synthetic Polynucleotide

SEQ ID NO: 579 - DNA, 1353 bp, Artificial Sequence; identical to SEQ ID NO: 136
  Synthetic Polynucleotide

SEQ ID NO: 580 - DNA, 1364 bp, Artificial Sequence; identical to SEQ ID NO: 144
  Synthetic Polynucleotide

SEQ ID NO: 581 - DNA, 1394 bp, Artificial Sequence; identical to SEQ ID NO: 165
  Synthetic Polynucleotide

SEQ ID NO: 582 - DNA, 1393 bp, Artificial Sequence; identical to SEQ ID NO: 94
  Synthetic Polynucleotide

SEQ ID NO: 583 - DNA, 1437 bp, Artificial Sequence
  Synthetic Polynucleotide
cgtgcttaacacatgcaagtcgaacgaagcactttgattgatttcttcggattgaaattttagtgactgagtggcggacgggtgagtaacgcgtgggtaacctgcctcacacagggggataacagttggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcgtcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccttttgcccggtcagtaatgtgaccttttcttcggaacaagagtgacaggtggtgcatggttgtcgtcagctcgtgtcgtgagatgttgggttaagtcccgcaacgagcgcaacccctattcttagtagccagcatataaggtgggcactctaggaagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcggtgacctaacgaaagaaggagccgccgaaggcaggtctgataactggggtg

SEQ ID NO: 584 - DNA, 1392 bp, Artificial Sequence; identical to SEQ ID NO: 82
  Synthetic Polynucleotide

SEQ ID NO: 585 - DNA, 1492 bp, Artificial Sequence; identical to SEQ ID NO: 11
  Synthetic Polynucleotide

SEQ ID NO: 586 - DNA, 1396 bp, Artificial Sequence; identical to SEQ ID NO: 153
  Synthetic Polynucleotide

SEQ ID NO: 587 - DNA, 1347 bp, Artificial Sequence; identical to SEQ ID NO: 32
  Synthetic Polynucleotide

SEQ ID NO: 588 - DNA, 1436 bp, Artificial Sequence; identical to SEQ ID NO: 301
  Synthetic Polynucleotide

SEQ ID NO: 589 - DNA, 1394 bp, Artificial Sequence; identical to SEQ ID NO: 84
  Synthetic Polynucleotide

SEQ ID NO: 590 - DNA, 1367 bp, Artificial Sequence; identical to SEQ ID NO: 168
  Synthetic Polynucleotide

SEQ ID NO: 591 - DNA, 1391 bp, Artificial Sequence; identical to SEQ ID NO: 89
  Synthetic Polynucleotide

SEQ ID NO: 592 - DNA, 1392 bp, Artificial Sequence; identical to SEQ ID NO: 42
  Synthetic Polynucleotide

SEQ ID NO: 593 - DNA, 1363 bp, Artificial Sequence; identical to SEQ ID NO: 41
  Synthetic Polynucleotide

SEQ ID NO: 594 - DNA, 1393 bp, Artificial Sequence; identical to SEQ ID NO: 132
  Synthetic Polynucleotide

SEQ ID NO: 595 - DNA, 1390 bp, Artificial Sequence; identical to SEQ ID NO: 77
  Synthetic Polynucleotide

SEQ ID NO: 596 - DNA, 1437 bp, Artificial Sequence; identical to SEQ ID NO: 258
  Synthetic Polynucleotide

SEQ ID NO: 597 - DNA, 1435 bp, Artificial Sequence; identical to SEQ ID NO: 243
  Synthetic Polynucleotide

SEQ ID NO: 598 - DNA, 1393 bp, Artificial Sequence; identical to SEQ ID NO: 86
  Synthetic Polynucleotide

SEQ ID NO: 599 - DNA, 1405 bp, Artificial Sequence
  Synthetic Polynucleotide
cagaacgaacgcccggcggcgccctcacacacgcaagacgaacggcgaagggtcaagctcgccggttccggacgcgcggcgaaacgggcgagtcacacgcgagtaacccgccctcttcttccggacaccgcacgaaatgcgcggctcatccgggataattccgggcccgtcgcacgacgggcccgggaaagacgcgcccttcgggcgtttttcggtgggagatgggctcgcggcctatcagcttcgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggcttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcaataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtc

SEQ ID NO: 600 - DNA, 1398 bp, Artificial Sequence; identical to SEQ ID NO: 271
  Synthetic Polynucleotide

SEQ ID NO: 601 - DNA, 1415 bp, Artificial Sequence
  Synthetic Polynucleotide
  misc_feature (892)..(892): n is a, c, g, or t
cttaacacatgcaagtcgaacgggctgcgcctgcccttgtggtgggtgtggttagtggcgaacgggtgagtaacacgtgagtaacctgcccctcactcctggataaccgcttgaaagggtggctaatacggggtgttctggtcctgctgcatggtggggttgggaaagatgcactgttagggtgtttttggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcggaagcctgatgcagcgacgccgcgtgagggatggaggccttcgggttgtgaacctctttcgccagtgaagaaggcgctcctcgttgtgggggtgttgacggtagctggataagaagcgccggctaactacgtgccagcagccgcggtaatacgtagggcgcgagcgttgtccggaattattgggcgtaaagagctcgtaggcggctggtcgcgtctgccgtgaaatcctctggcttaactgggggcgtgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtgggggctctttccggggtctccgcgccgtagctaacgcattaagtgccccgcctggggagtacggccgcaaggctaaaactcaaaggaattgncgggggcccgcacaagcggcggagcatgcggattaattcgatgcaacgcgaagaaccttaccaaggcttgacatgttccggtcgcccgcggagacgtgggttcctccttgtggggccggttcacaggtggtgcatggttgtcgtcagctcgtgtcgtgagatgttgggttaagtcccgcaacgagcgcaacccttgtcccgtgttgccagcacgtcgtggtggggactcgcgggagactgccggggtcaactcggaggaaggtggggatgacgtcaaatcatcatgccccttatgtcttgggcttcacgcatgctacaatggccggtacagagggttgcgatgtcgtgaggcggagcgaatcccttaaagccggtctcagttcggatcggtgtctgcaactcgacaccgtgaagtcggagtcgctagtaatcgcagatcagcaacgctgcggtgaatacgttctcgggccttgtacacaccgcccgtcacgtcatgaaagtcggcaacacccgaagcccgtgg

SEQ ID NO: 602 - DNA, 1419 bp, Artificial Sequence
  Synthetic Polynucleotide
tggctcagggcgaaacgcctggcggcgtgcttaacacatgcaagtcgaacgggccttgtcctcttttttttttgggggtggggttagtggcgaacgggtgagtaacacgtgagtaacctgcccctcacttctggataaccgcttgaaagggtggctaatacggggtgttctggcctgctcgcatgggtgggtttggaaagattcgaccggttttggttgttttggtgggggatgggctcgcggcctatcagcttgttggtggggtgatggcctgccaaggctttgacgggtagccggcctgagagggtgggcggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagaaggtcctgctctttgtggtggggttgacagtagctgggttaatgaagcgccggctaactacgtgccagcagccgcggtaatacgtagggcgcgagcgttgtccggaattattgggcgtaaagggcttgtaggcggctggtcgcgtctgccgtgaaatcctctggctcagctgggggcgtgcggtgggtacgggctggcttgagtgcggtaggggagactggagctcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcgtgcggattaattcgatgcaacgcgaagaaccttaccaaggcttgacatgggctggattgcttcggagacggggtttcccttttttgggctggttcacaggtggtgcatggttgtcgtcagctcgtgtcgtgagatgttgggttaagtcccgcaacgagcgcaacccttgtctcgtgttgccagcacgttgtggtggggactcgcgggaggctgccggggttaactcggaggaaggtggggatgacgtcaaatcatcatgccccttatgtcttgggctccacgcatgctacaatggccggtacagtgggttgcgatgctgtgaggcggagcgaatccctgaaagccggtctcagttcggatcggtgtctgcaaactcgacaccgtgaagttggagtcgctagtaatcgcagaatcagcagcgctgcggtgaatacgttctcgggccttgcacacaccgcccgtca

SEQ ID NO: 603 - DNA, 1401 bp, Artificial Sequence
  Synthetic Polynucleotide
aacgctggcggcctgcttaacacatgcaagttcaacggtgaaagggaccagcttcgctggttccggatgagtcggcgaacgggtcgagtaacacgcgagtaacctgcctccttctttctggataaccgcatgaaagtcgtcggctaatacgggatattctgggtctgtcgcatgacgggcccgggaaagaagcgcctttgggcgttttcggttgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtaaacctctttcgccagtgaagcaggcctgctccttgtgggtgggttgacggttgctggataagaagcgccggctaactacgtgccagcagccgcggtaatacgtagggcgcgagcgttgtccggagttattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggcttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgtacacaccgcccgtc

SEQ ID NO: 604 - DNA, 1367 bp, Artificial Sequence; identical to SEQ ID NO: 217
  Synthetic Polynucleotide

SEQ ID NO: 605 - DNA, 1395 bp, Artificial Sequence
  Synthetic Polynucleotide
cggcgcgctaaacacatgcaagtccgaaacggtgaagcgcttttccttttcggttcggcgcggaagagcggcgaacgggtcgagtaacacgtgagtaacctgcccccttcttctggataaccgcatgaaagtgtggctaatacgggatattctgcgcctgctgcatggtgggtgtgggaaagattgtgcctttgggtcgttttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcccaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggatcggtgtctgcaactcgacaccgtgaagttggagtcgctagtaatcgcagatcagcaacgctgcggtgaatacgttctcgggccttgcacacaccgcccgtc

SEQ ID NO: 606 - DNA, 1417 bp, Artificial Sequence
  Synthetic Polynucleotide
ctggctcgggacgatcgctggcgcggctgcttaacacatgcaagtccaacggagtaccgctttcctttttgattggtgtggatgagtgccgaacgggagagtatatacgtgaattaacctgcccccttcttctggataaccccgtgatggtgtgtgtaatacgggatattctgcgcctgctggatggtgggtgtgggaaagattgtgcctttgggtgctgtccggcgggggatgggctcgcggactatcagcttgttggtggggtgatgggctaccaagggggtgactggtagccggcctgagagggtggacggtcacactgggactgagacacggcccaccactcctactggaggaagcagtggggaatattgcacaatgggcgcaagcctgatgcatggacaccgcgctgagggatggacgccttcgggttgtgaacctctttcgccagtgaagcagggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtccctcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcggttcggatcggtgtctgcaactcgacaccgtgaagttggagtcgctagtaatcgcagatcagcaacgctgcggtgaatacgttctcgggcctttacacaccgcccgtca

SEQ ID NO: 607 - DNA, 1521 bp, Artificial Sequence
  Synthetic Polynucleotide
agagtttgatcctggctcaggacgaacgctggcggcgtgcttaacacatgccagtcgaacgggccggccccttgttatttgggcggttggttgagtggcgaacgggtgagtaacacgtgagtaacctgccctcttcttctggataaccgcatgaaagtgtggctaatacgggatattctggtctgcctgcatgggtgggttgggaaagattcactttggtgttttggtgggggatgggctcgcggcctatcagcttgttggtgcggtgatggcctaccaaggcggtgacgggtagccggcctgagagggtgcgcggtcacactgggactgagatacggcccagactcctacgggaggcagcagtgggggatattgcacaatgggcggaagcctgatgcagcgacgtcgcgtgagggatggaggccttcgggttgtgaacctctttcgccagtgaagtaggtctgctcctgtgtgggtgcgttgacggtagctgggttttaaagaagcgccggctaactacgtgccagcagccgcggtgatacgtagggcgcgagcgttgtccggaattattgggcgtaaagggcttgtaggcggctggtcgcgtctgccgtgaaatcctctggcttaactgggggtgtgcggtgggtacgggtcggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccatgctgtaaaacgttgggcactaggtgtggggggtctttcgggggtcttccgcgccgtagctaaacgcattaagtgccccgcctgtggagtacggccgcaaggctaaaactcaaaggaattgacgggggcccgcacaagcggcggagcatgcggattaattcgatgcaacgcgaagaaccttaccaaggcttgacatgggccggtggttcccggagacgggagcgtcccctttttgtgggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccctgtacacgccgcccgtcacgtcatgaaagtcggcaacacccgaagcccgtggccttatggggagcggtcgaaggtggggctggtgattgggacgaagtcgtaacaaggtaacc

SEQ ID NO: 608 - DNA, 1549 bp, Artificial Sequence
  Synthetic Polynucleotide
gagtttgatyctggctcaggacgaacgctggcggcgtgcttaacacatgcaagtcgaacggaaaggcccccaccatttttggtgggggtgctcgagcggcgaacgggtgagtaacacgtgggtgatctgccctgtacttcgggataagcttgggaaactgggtctaataccggataggaccatggtttagtgtctcatggtggaaaaattattgttttggtgcaggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatggaggccttcgggttgtgaacctctttcgccagtgaagaaggtcctgctctttgtggtggggtcgacggtagctgggttaatgaagcgccggctaactacgtgccagcagccgcggtaatacgtagggcgcgagcgttgtccggaattattgggcgtaaagggcttgtaggcggctggtcgcgtctgccgtgaaatcctctggctcagctgggggcgtgcggtgggtacgggctggcttgagtgcggtaggggagactggaactcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttacctgggtttgacatgcaccagacggttgtagagatacgtacctccctttgtggttggtgtgcaggtggtgcatggttgtcgtcagctcgtgtcgtgagatgttgggttaagtcccgcaacgagcgcaacccttgtcttatgttgccagcactttgggtggggactcatgagagactgccggggttaactcggaggaaggtggggatgacgtcaaatcatcatgccctttatgcccagggcttcacacatgctacaatggttagtacaacgcgctgcgaacctgtgagggtgagcgaatcgctgaaagctaatctcagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagcccatggcctaaccaccatttggtggggggagtggtcgaaggtgggattggcgattgggacgaagtcgtaacaaggtagccgtaccggaaggtgcggytggawcacctcctt

SEQ ID NO: 609 - DNA, 1413 bp, Artificial Sequence; identical to SEQ ID NO: 267
  Synthetic Polynucleotide

SEQ ID NO: 610 - DNA, 1442 bp, Artificial Sequence; identical to SEQ ID NO: 277
  Synthetic Polynucleotide

SEQ ID NO: 611 - DNA, 1526 bp, Artificial Sequence
  Synthetic Polynucleotide
gacgaacgctggcggcgtgcttaacacatgcaagtcgaacgggctttcctgccggtttttgctggtgggttggttagtggcgaacgggtgagtaacacgtgagtaacctgccctcttctcctggataactgcttgaaagggcggctaatacggggtggtctggcctgcctgcatgggtgggttggtataggttcagcattttgttgttccggtgggggatgggctcgcggcttatcagcttgttggtggggtgatggcttaccaaggctttgacgggtagccggcctgagagggtggacggtcacactgggactgagatacggcccagactcctgcgggaggcagcagtggggaatattgcacaatgggcggaagcctgatgcagcgacgtcgcgtgagggatggaggccttccggttgtgaacctctttttccggtggtgaaggcctgcttctttgtgggtgggttgacggtagccgggttaggaagcgccggctaactacgtgccagcaagccgcggtaatacgtagggcgcgagcgttgtccggaattactgggcgtaaagggcttgtaggcggctggtcgcgtctgccgtgaaatcctctggcttaactgggggcttgcggtgggtacgggctggcttgagcgcggtaggggagactggaactcctggtgtagcggtggaatgcgcagatatcaggaggaacaccggtggcgaaggcgggtctctgggctgttgctgacgctgaggagcgaaagcgtggggagcgaacaggattagataccctggtagtccacgctgtaaacgttgggcactgggtgtgggggcccttttccggggtttccgcgccgtagctaacgcgttaagtgccccgcctggggagtacggccgcaaggctaaaactcaaaggaattgacgggggcccgcacaagcggcggagcatgcggattaattcgatgcaacgcgaagaaccttaccaaggcttgacatgggtcggttgctgccggagacggtggttcccttgctgcgttttgttgtttgggccggcctgcaggtggtgcatggttgtcgtcagctcgtgtcgtgagatgttgggttaagtcccgcaacgagcgcaacccctgtcccgtgttgccagcgcttttgggcggggactcgcgggagactgccggggtgaactcggaggagggtggggatgacgtcaaatcatcatgccccttatgtcttgggcttcacgcatgctacaatggccggtacagtgggttgcgatgccgtgaggcggggcgaatcccttaaagccggtctcagttcggatcggtgcctgcaactcggcaccgtgaagttggagtcactagtaatcgcggatcagcaacgccgcggtgaatacgttctcgggccttgtacacaccgcccgtcacgtcatgaaagccggtgacgcccgaagcccgtggccctatggggagcggtcgaaggcggggctggtgattgggacgaagtcgtaacaaggtagccgtaccggaaggtgc

SEQ ID NO: 612 - DNA, 1543 bp, Artificial Sequence
  Synthetic Polynucleotide
gagtttgattctggctcaggacgaacgctggcggcgtgcttaacacatgcaagtcgaacgggcccgctctcttttttgggggtgggttgagtggcgaacgggtgagtatcacgtgagtaacctgccccctgctcctggataactgcttgaaagggcggctaatacggggtgtgccggctggtccgcatgggcctggtcgggatagtttcatcttcgggtgtttcggtgggggatgggctcgcggcctatcagcttgttggtggggtgatggcccaccaaggcggtgacgggtagccggcctgagagggtgggcggccacactgggactgagacacggcccagactcctgcgggaggcagcagtggggggtattgcacaatgggcggaagcctgatgcagcgacgtcgcgtgagggatggaggccttcgggttgtgaacctctttctccggtggtgaaggccctgtccgttgcggcggggttgacggtagccgggtatgaagcgccggctaactacgtgccagcagccgcggtaatacgtagggcgcgagcgttgtccggaattattgggcgtgaagggcttgtaggcggccggtcgcgtccgccgtgaaattctccggctcaaccgggggcttgcggtgggtacgggccggctggagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccttatggggagcggtcgaaggtggggctggtgattgggacgaagtcgtaacaaggtagccgtaccggaaggtgcggctggatcacctcctt

SEQ ID NO: 613 - DNA, 1371 bp, Artificial Sequence
  Synthetic Polynucleotide
gacgaacgctggcggcgtgcttaacacatgcaagtcgaacgggatctgcgtggcctttgtggttgtgtggtgagagtggcgaacgggtgagtaacacgtgagtaacctgcctttttctttgggataacgctcagaaatgggtgctaatactggatgttctgcgctttccgcatggggggtgtgggaaaggggcctttgtggtttctggagggagatgggctcgcggcttgtcagcttgttggtggggtgatggcttaccaaggctttgacgggtagccggcctgagagggtgggcggtcacattgggactgagatacggcccagactcctacgggaggcagcagtggggaattttgcacaatggggggaaccttgatgcagcgacgccgcgtgagggatggaggccttcgggttgtgaacctctttcgctcgtgtgcaagccgctatttgggtagtggtgagtgtagcgggtaaagaagcgccggctaactacgtgccagcagccgcggtaatacgtagggcgcgagcgttgtccggatttattgggcgtaaagggcttgtaggcggtttgtcgcgcctgtcgtgtaatcctctggcttaactgggggtgtgcggtgggtacgggcaggcttgagtgcggtaggggagattggaattcctggtgtagcggtggaatgcgcagatatcaggaggaacaccggtggcgaaggcgggtctctgggccgttactgacgctgaggagcgaaagcgtggggagcgaacaggattagataccctggtagtccatgctgtaaacgttgggcactaggtgtgggggccgcccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccctgggcgcctagagataggtgtgcatttggttgggggtgtgcaggtggtgcatggttgtcgtcagctcgtgtcgtgagatgttgggttaagtcccgcaacgagcgcaatccttgccctatgttgccagcgcgttatggtggggactcgtgggggactgccggggttaactcggaggaaggtggggatgacgtcaaatcatcatgccccttatgtcttgggcttcacgcatgctacaatggcaggtacagagggttgcgatgctgtgaggtggagcgaatcctttaaagcttgtctcagttcggatcggggtctgcaattcgacctcgtgaaggtggagtcgctagtaatcgcagatcagctacgctgcggtgaatacgttctcgggcct

SEQ ID NO: 614 - DNA, 1429 bp, Artificial Sequence; identical to SEQ ID NO: 276
  Synthetic Polynucleotide
  misc_feature (758)..(758): n is a, c, g, or t

SEQ ID NO: 615 - DNA, 1436 bp, Artificial Sequence
  Synthetic Polynucleotide
ggctcagggcgaacgccggcggcgtgcctaacacacgcaagttcgaacgaggctccgcccggctttcggttcgggcgggcgagcggcgaaacgggcgagtaaacacgtcgagtaacccgcctcttctttcttctcggataaaccgcttcgaaagggcggctaatacgggaacgttctggctcgcctcgcacgggagcggttcggaaaagattcggcccggttttcggttcgtttcggtcgggggaacgggctcgcggcttatcagcttcgttggtggggtcgaaggcctaccaaggcggtgacgggtagccggcctgagagggtggacggtcacactgggactgagacacggcccagactcctgcgggaggcagcagtgggggattttgcacaatgggcgcaagcctgatgcagcgacgccgcgtgagggaaggaggccttcgggtttgtgaacctctgtcgccggtgatgtaggctctgcttttgtgggtggggtttacggtagccggggtatgaagtgccggctaactacgtgccagccagccgcggtaatacgtagggcgcgagcgttgtccggaattattgggcgtaaagagctcgtaggcggctggtcgcgtctgtcgtgaaatcctctggcttaactgggggcgtgcggtgggtacgggccggcttgagtgcggtaggggaggctggaactcctggtgtagcggtggaatgcgcagatatcaggaggaacaccggtggcgaaggcgggtctctgggccgtgtactgacgctgaggagcgaaagcgtggggagcgaacaggattagataccctggtagtccatgctgtaaacgttgggcactaggtgtggggggtctttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggtggttcccggagacgggagcgtcccctttttgtgggctggttcacaggtggtgcatggttgtcgtcagcttgtgtcgtgagatgttgggttaagtcccgcaacgagcgcaacccttgtctcgtgttgccagcacgttgtggtggggactcgcgggagactgccggggtcaactcggaggagggtggggatgacgtcaaatcatcatgccccttatgtcttgggcttcacgcatgctacaatggccggtacagtgggttgcgatgtcgtgaggcggagcgaatccctgaaagccggtctcagttcggatcggtgtctgcaactcgacaccgtgaagttggagtcgctagtaatcgcagatcagcaacgctgcggtgaatacgttctcgggccttgtacacaccgcccgtc

SEQ ID NO: 616 - DNA, 1405 bp, Artificial Sequence
  Synthetic Polynucleotide
agtttgaccatggctcaagacgaaccctggcggcgtgcttaacacacgcaagttcaacggtcgaagggactcggtttttcgctcggttccggaagagcggcgaaacgggcgagtaacacgtgagtaacctcgccccctttcttctggataaccgcacgaaagtcgtcggctaatacgggatattctgggtctgtcgcatggtgggctcgggaaagatattgtttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgccccttggtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccgaggcttgacatgtgccggtttgctccggagacggggtttcctccttgtggggtcggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccttaaagccggtctcagttcggaatcggtgtctgcaaactcgacaccgtgaagttggagtcgctagtaatcgcagatcggcaacgctgcggtgaatacgttctcgggccttgt

SEQ ID NO: 617 - DNA, 1364 bp, Artificial Sequence
  Synthetic Polynucleotide
gacgaacgctgtcggcgtgcttaacacatgcaagtcgaacggtgaagcccttttttgggtggatgagtggcgaacgggtgagtaacacgtgagtaacctgcccccttcttctggataacctcatgaaagtggggctaatacgggatattctggtctgtgcgcatgcatgggttgggaaaggtttttttctggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggctcatctctttgtgggtgggttgacggtagctggataagaagcgccggctaactacgtgccagcagccgcggtaatacgtagggcgcgagcgttgtccggaattattgggcgtaaagaactcgtaggcggctggtcgcgtctgtcgtgaaatcctctggcttaactgggggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtggggggccttttccgggttcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgagggcgatcgtcccggagacggggctaccattttttggcgctcttacgggtggtgcatggttgtcgtcagctcgtgtcgtgagatgttgggttaagtcccgcaacgagcgcaacccttgtcctgtgttgccagcacgttgtggtggggactcgcgggagactgccggggtcaactcggaggaaggtggggatgacgtcaaatcatcatgccccttatgtcttgggcttcacgcatgttacaatggccggtacagagggctgcgatgctgtgaggcggagcgaatcccttaaagccggtctcagttcggatcggtgtctgcaactcgacaccgtgaagttggagtcgctagtaatcgcagatcagcaacgctgcggtgaatacgttctcgggcct

SEQ ID NO: 618 - DNA, 1365 bp, Artificial Sequence
  Synthetic Polynucleotide
gacgaacgctggcggcgtgcttaacacatgcaagtcgaacggtgaagccccagcttgctggggtggatgagtggcgaacgggtgagtaacacgtgagtaacctgcccccttctcctggataactgccggaaacggtagctaatacgggatattcaggtcctgccgcatggtggggtctggaaaggtttttctggtgggggatgggctcgcggcctatcagcttgttggtggggtgatggcctaccaaggctttgacgggtagccggcctgagagggtggacggtcacactgggactgagacacggcccagactcctacgggaggcagcagtggggaatattgcacaatgggcgcaagcctgatgcagcgacgccgcgtgagggatgaaggccttcgggttgtaaacctctttcgccagtgaagcaggccaggccttattcgcctggttgacggtagctggataagaagcgccggctaactacgtgccagcagccgcggtaatacgtagggcgcaagcgttgtccggaattattgggcgtaaagagctcgtaggcggctggtcgcgtctgtcgtgaaatcccctggcttaactgggggcttgcggtgggtacgggccggcttgagtgcggtaggggggactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtgggggctctttccggggtttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgagcgacagccgcagagatgtggtctcccccttgtggggcgctctcacaggtggtgcatggttgtcgtcagctcgtgtcgtgagatgttgggttaagtcccgcaacgagcgcaaccctcgtcccgtgttgccagcacgtagtggtggggactcgcgggagactgccggggtcaactcggaggaaggtggggatgacgtcaaatcatcatgccccttatgtcttgggcttcacgcatgctacaatggccggtacagtgggttgcgatgccgtgaggtggagcgaatcccttaaagccggtctcagttcggatcggtgtctgcaactcgacaccgtgaagttggagtcgctagtaatcgcagatcagcaacgctgcggtgaatacgttctcgggcct

SEQ ID NO: 619 - DNA, 1397 bp, Artificial Sequence; identical to SEQ ID NO: 189
  Synthetic Polynucleotide

SEQ ID NO: 620 - DNA, 1503 bp, Artificial Sequence
  Synthetic Polynucleotide
agagtttgatcctggctcaggatgaacgctgacagaatgcttaacacatgcaagtcgaacggtgaaggggcctgcttttgtgggtcctggatgagtggcgaacgggtgagtaacacgtgagtaacctgcccccttcttctggataaccgcatgaaagtgtggctaatacgggatattctgggtctgtcgcatggtgggtctgggaaaggttttttccggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgctccttttttgtgggtgggttgacggtagctggataagaagcgccggctaactacgtgccagcagccgcggtaatacgtagggcgcgagcgttgtccggaattattgggcgtaaagagcttgtaggcggttggtcgcgtctgctgtgaaaggctggggcttaaccctggttttgcagtgggtacgggctaactagagtgcagtaggggagactggaattcctggtgtagcggtggaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgcgccgcctggggagtacggccgcaaggctaaaactcaaagaaattgacgggggcccgcacaagcggcggagcatgcggattaattcgatgcaacgcgaagaaccttaccaaggcttgacatatactggactgcgtcagagatggcgtttcccttcggggctggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacagagggttgcgatactgtgaggtggagcgaatcctttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggccctacggggagcggtcgaaggtggggctggtgattgggacgaagtcgtaacaaggtaacc

SEQ ID NO: 621 - DNA, 1421 bp, Artificial Sequence
  Synthetic Polynucleotide
agtttgttcatggcttaaggcgaacgcctggcggcgtgcttaacacatgcaagttcgaacgggctttctggggtttctggctttttggtttggggtttctgggggttagtggcgaacgggtgagtaacacgtgagtaacctgcccttcacttctggataaccgcttgaaagggtggctaatacgggatgtttctgggtctgtcgcatggcgggttcgggaaagatggcactgtttggtgtttttggtgggggatgggctcgcggcctatcagcttgttggtggggtgatggcctgccaaggctttgacgggtagccggcctgagagggtgggcggtcacactgggactgagatacggcccagactcctacgggaggcagcagtggggaatattgcacaatgggcggaagcctgatgcagcgacgtcgcgtgaggggtggaggccttcgggttgtgaacctctttcgccagtgaggaaggccttgcccgtgtggtggggttgacggtagctgggttaattgaagcgccggctaactacgtgccagcagccgcggtaatacgtagggcgcgagcgttgtccggaattattgggcgtaaagggcttgtaggcggttggtcgcgtctgccgtgaaatcctctggctcagctgggggcgtgcggtgggtacgggctggcttgagtgcggtaggggaggctggaactcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtggggggtctttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaacttaccaaggcttgacatgtgccggttgtccttggaggacggggggtcctccctatttgtgggggctggttcacaggtggtgcatggtggtcgtcagctcgtgtcgtgagatgttgggttaagtcccgcacgaggcgcaacccttgtcccgtgttgccagcacgttgtggtggggactcgcgggagactgcgggggttaactcggaggggggtggggaggacgtcaaatcatcatcccccttatgttcttgggcttcacgcatgctacaatggccggtacagtgggttgggatgtcgtgaggcggagcgatccccttaaagccggtctcggttggaatcggtgtctgcgaactggaccccggaaagctgggttcgctggtaatcgcagatcaggcagcggctgcggtgaatacgtt

SEQ ID NO: 622 - DNA, 1526 bp, Artificial Sequence
  Synthetic Polynucleotide
gagtttgatcctggctcaggacgaacgctggcggcgtgcttaacacatgcaagtcgaacgatgatgcggtgcgtgcaccgttgattagtggcgaacgggtgagtaacacgtgagtaacctgccctcttctttgggataacggtctgaaagggctgctaatactgaatattcacatgtcttcgcatgggggtgtgtggaaagagatgcttttgggtgtttttggtgggggatgggctcgcggcctatcagcttgttggtggggtagtggcctaccaaggctttgacgggtaaccggcctgagagggtgaccggtcacattgggactgagatacggcccagactcctacgggaggcagcagtggggaattttgcacaatggacgcaagtctgatgcagcgacgccgcgtgagggatgtaggccttcgggttgtgaacctctttcgctcatggtcaagccgcagctttgggttgtggtgagggtagtgggtaaagaagcgccggctaactacgtgccagcagccgcggtaatacgtagggcgcgagcgttgtccggaattattgggcgtaaagggcttgtaggcggttggtcgcgtctgccgtgaaatcctctggcttaactgggggcgtgcggtgggtacgggctggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgcgccctgacgctgcagagatgtggtggcatttggttgggggtgtacaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggctggtacagagggttgcgatgtcgtaaggcggagcgaatcccttaaagctggtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagctcatggcctaaccggtttgtctggggggagtggtcgaaggtgggattggcgattgggacgaagtcgtaacaaggtagccgtaccggaaggtgc

SEQ ID NO: 623 - DNA, 1546 bp, Artificial Sequence; identical to SEQ ID NO: 12
  Synthetic Polynucleotide

SEQ ID NO: 624 - DNA, 1367 bp, Artificial Sequence
  Synthetic Polynucleotide
gacgaacgctggcggcgtgcttaacacatgcaagtcgaacggactgcttcaagcttgcttggggtggtgagtggcgaacgggtgagtaacacgtgagtaacctgccctcttctttgggataacggccggaaacggctgctaataccgggtattcactggtcctcgcatgggggttggtggaaaggggcctcgtttggggtttctggtgggggatgggctcgcggcttatcagcttgttggtggggtgatggcctaccaaggctttgacgggtagccggcctgagagggtgaccggtcacattgggactgagatacggcccagactcctacgggaggcagcagtggggaattttgcacaatgggcgcaagcctgatgcagcgacgccgcgtgagggatggaggccttcgggttgtgaacctctttcgctcatggtcaagccgcggatgtgtccgtggtgagggtagtgggtaaagaagcgccggctaactacgtgccagcagccgcggtaatacgtagggcgcgagcgttgtccggaattattgggcgtaaagggcttgtaggcggtttgtcgcgtctgccgtgaaattccctggcttaactgggggcgtgcggtgggtacgggcaggcttgagtgcggtaggggagactggaattcctggtgtagcggtggaatgcgcagatatcaggaggaacaccggtggcgaaggcgggtctctgggccgttactgacgctgaggagcgaaagcatggggagcgaacaggattagataccctggtagtccatgctgtaaacgttgggcactaggtgtggggaccgtccttggtttctgcgccgtagctaacgctttaagtgccccgcctggggagtacggccgcaaggctaaaactcaaaggaattgacgggggcccgcacaagcggcggagcatgcggattaattcgatgcaacgcgaagaaccttaccaaggcttgacatgtaccgcgacactgcagagatgtggtggccttcggggtggtgcacaggtggtgcatggttgtcgtcagctcgtgtcgtgagatgttgggttaagtcccgcaacgagcgcaacccttgccctatgttgccagcacgttgtggtggggactcgtgggggactgccggggttaactcggaggaaggtggggatgacgtcaaatcatcatgccccttatgtcttgggcttcacgcatgctacaatggtcggtacagagggttgcgatgccgcaaggtggagcgaaccccttaaagccggtctcagttcggattggggtctgcaactcgaccccatgaaggtggagtcgctagtaatcgcagatcagcaacgctgcggtgaatacgttctcgggcct

SEQ ID NO: 625 - DNA, 1430 bp, Artificial Sequence
  Synthetic Polynucleotide
cctggctcaggacgaacgctggcggcgtgcttaacacatgcaagtcgaacggtgatgctccaagcttgctggggttgatgagtggcgaacgggtgagtaacacgtgagtaacctgcccccttcttctggataactgcctgaaagggtagctaatacgggatattctggcctgctcgcatgggtgggtttggaaaggttttttctggtgggggatgggctcgcggcctatcagcttgttggtggggtgatggcctaccaaggcggtgacgggtagccggcctgagagggtggacggccacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggccatgccttcttggtgtggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcccctggcttaactgggggcttgcggtgggtacgggccggcttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgccgtaaacgttgggcactaggtgtgggggctctttccggggcttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgagcgccggtcccggagacggggcctcctccttgtggggcgctctcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccccttatgtcttgggcttcacgcatgctacaatggccggtacagagggttgcgatgtcgtgaggcggagcggatcccttaaagccggtctcagttcggatcggtgtctgcaactcgacaccgtgaagttggagtcgctagtaatcgcagatcagcaacgctgcggtgaatacgttctcgggccttgtacacaccgcccgtcacgtcatgaaagtcggcaacacccgaagcccgtggc

SEQ ID NO: 626 - DNA, 1544 bp, Artificial Sequence; identical to SEQ ID NO: 14
  Synthetic Polynucleotide

SEQ ID NO: 627 - DNA, 1506 bp, Artificial Sequence
  Synthetic Polynucleotide
gctggcggcgtgcttaacacatgcaagtcgaacgggatccaaaggctttttgtttttggtgagagtggcgaacgggtgagtaacacgtgagtaacctgcccccttcttttggataaccgcatgaaagtgtggctaatacaggatattccaggctggtcgcatgattggtttgggaaatggtttggtctggtgggggatgggctcgcggcctatcagcttgttggtggggtgatggcctaccaaggcggtgacgggtagccggcctgagagggtgggcggtcacactgggactgagatacggcccagactcctacgggaggcagcagtgggggattttgcacaatgggcgcaagcctgatgcagcgacgccgcgtgagggatgaaggccttcgggttgtaaacctctttcgctgggttgaaaggccatgctttgggtgtggttgatttgaactggtaaagaagtaccggctaactacgtgccagcagccgcggtaatacgtagggtactagcgttgtccggatttattgggcgtaaagggcttgtaggtggtttgtcgcgtctgtcgtgaaatcctgtggcttaaccatgggcttgcggtgggtacgggcaggcttgagtgcggtaggggagactggaattcctggtgtagcggtggaatgcgcagatatcaggaggaacaccggtggcgaaggcgggtctctgggccgttactgacactgaggagcgaaagcgtggggagcgaacaggattagataccctggtagtccatgctgtaaacgttgggcactaggtgtgggggccgtgtggtttctgcgccgtagctaacgcattaagtgtcccgcctggggagtacggccgcaaggctaaaactcaaaggaattgacggggacccgcacaagcggcggagcatgcggattaattcgatgcaacgcgaagaaccttaccaaggcttgacatgcaccggtacagtgtagagatatgctggcctttttggctggtgtgcaggtggtgcatggttgtcgtcagctcgtgtcgtgagatgttgggttaagtcccgcaacgagcgcaacccttgtctcgtgttgccagcatttggttggggactctcgagagactgccggggttaactcggaggaaggtggggatgacgtcaaatcatcatgccccttatgtcttgggcttcacgcatgctacaatggatggtacagagggttgcgatactgtgaggtggagctaatcccttaaagctgttctcagttcggatcgtagtctgcaactcgactacgtgaaggtggagtcgctagtaatcgcagatcagcaacgctgcggtgaatacgttctcgggtcttgtacacaccgcccgtcacgtcacgaaagttggtaacacccgaagcccgtggcctaaccatgttttgtggggggagtggtcgaaggtgggattggcgattgggacgaagtcgtaacagggtagccgtaccggaaggtgcggctggatcaccttcctt

SEQ ID NO: 628 - DNA, 1498 bp, Artificial Sequence; identical to SEQ ID NO: 279
  Synthetic Polynucleotide

SEQ ID NO: 629 - DNA, 1358 bp, Artificial Sequence; identical to SEQ ID NO: 220
  Synthetic Polynucleotide

SEQ ID NO: 630 - DNA, 1540 bp, Artificial Sequence
  Synthetic Polynucleotide
gagtttgatyctggctcaggacgaacgctggcggcgtgcttaacacatgcaagtcgaacgggccttgtcccctttttttttgggggtggggttagtggcgaacgggtgagtaacacgtgagtaacctgcccctcacttctggataaccgcttgaaagggtggctaatacggggtgttctggcctgctcgcatgggtgggtttggaaagattcgaccggttttggtgtttttggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcwcaatgggcgcaagcctgatgcagcgacgccgcgtgagggatggaggccttcgggttgtaaacctctttcgccagtraagcaggcctgctccttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggagactggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggcactaggtgtggggggccttttccgggtcttccgcgccgtagctaacgcattaagtgccccgcctggggagtacggccgcaaggctaaaactcaaaggaattgacgggggcccgcacaagcggcggakcatgcggattaattcgatgcaacgcgaagaaccttaccaaggcttgacatgtgccggtcggctccggagacggggcttcctccttgtggggccggttcacaggtggtgcatggttgtcgtcagctcgtgtcgtgagatgttgggttaagtcccgcaacgagcgcaacccttgtcccgtgttgccagcacgttgtggtggggactcgcgggagactgccggggtcaactcggaggaaggtggggatgacgtcaaatcatcatgccctttatacccagggcttcacacatgctacaatggtcggtacaacgggttgcgacactgtgaagtgaagctaatctcttaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcctaaccaccacctgtggtggggagtggtcgaaggtgggattggcgattgggacgaagtcgtaacaaggtagccgtaccggaa

SEQ ID NO: 631 - DNA, 1420 bp, Artificial Sequence; identical to SEQ ID NO: 268
  Synthetic Polynucleotide
  misc_feature (779)..(779): n is a, c, g, or t

SEQ ID NO: 632 - DNA, 1388 bp, Artificial Sequence; identical to SEQ ID NO: 1
  Synthetic Polynucleotide
  misc_feature (7)..(7): n is a, c, g, or t
  misc_feature (407)..(408): n is a, c, g, or t
  misc_feature (728)..(728): n is a, c, g, or t

SEQ ID NO: 633 - DNA, 1416 bp, Artificial Sequence
  Synthetic Polynucleotide
gagtttgatcatggctcaggacgaacgctggcggcgtgcttaacacatgcaagtcgaacggtgaaggggcctgcttttgtgggtcctggatgagtggcgaacgggtgagtaacacgtgagtaacctgcccccttcttctggataaccgcatgaaagtgtggctaatacgggatattctgggtctgtcgcatggtgggcctgggaaaggttttttccggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgctccttttttgtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgctgtaaacgttgggcactaggtgtggggggtctttccgggtcttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggttgtccttcggagacggggggtcctccctatttgtgggggtcggttcacaggtggtgcatggttgtcgtcagctcgtgtcgtgagatgttgggttaagtcccgcaacgagcgcaacccttgtcccgtgttgccagcacgttgtggtggggactcgcgggagactgccggggttaactcggaggagggtggggatgacgtcaaatcatcatgccccttatgtcttgggcttcacgcatgctacaatggccggtacagtgggttgcgatgtcgtgaggcggagcgaatcccttaaagccggtctcagttcggatcggtgtctgcaactcgacaccgtgaagctggagtcgctagtaatcgcagatcagcagcgctgcggtgaatacgttctcgggccttgcacacaccgcccgtc

SEQ ID NO: 634 - DNA, 1358 bp, Artificial Sequence; identical to SEQ ID NO: 218
  Synthetic Polynucleotide

SEQ ID NO: 635 - DNA, 1467 bp, Artificial Sequence; identical to SEQ ID NO: 196
  Synthetic Polynucleotide

SEQ ID NO: 636 - DNA, 1401 bp, Artificial Sequence
  Synthetic Polynucleotide
agagtttgatcatggctcaggacgaacgctggcggcgtgcttaacacatgcaagtcgagcggtgaagggactggttttgctggtcctggatgagtggcgaacgggtgagtaacacgtgagtaacctgcctccttcttctggataaccgcatgaaagtgtggctaatacgggatattctgggtctgtcgcatggtgggcctgggaaaggttttttccggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggcctccgggttgtgaacctctttcgccagtgaagcaggcctgctccttttttatgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgtaaacgttgggtactaggtgtggggggccttttccgggttttccgcaccgtagctaacgcattaagtgtcccgcctggggagtacggccgcaaggctaaaactcaaaggaattgacgggggcccgcacaagcggcggagcatgcggattaattcgatgcaacgcgaagaaccttaccaaggcttgacatgtgccggtctgctccggagacggggtttcctcccttgtgggggctggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggctgcgataccgtgaggtggagcgaatcccagaaaatgcattcgtagtccgggatcgtagtctgcaactcgactacgtgaagctggaatcgctagtaatcgcggatcagcatgccgcggtgaatacgttcccgggtcttgta

SEQ ID NO: 637 - DNA, 1396 bp, Artificial Sequence
  Synthetic Polynucleotide
agagtttgatcatggctcaggacgaacgctggcggcgtgcttaacacatgcaagtcgaacggtgaagcgccttcctttttggtgggtgtggatgagtggcgaacgggtgagtaacacgtgagtaacctgcccccttcttctggataaccgcatgaaagtgtggctaatacgggatattctgggtctgtcgcatgatgggtctgggaaagatattgcttcggtgggggatgggctcgcggcctatcagcttgttggtggggtgatggcctaccaaggcggtgacgggtagccggcctgagagggtggacggtcacactgggactgagacacggcccagactcctacgggaggcagcagtggggaatattgcacaatgggcgcaagcctgatgcagcgacgccgcgtgagggatggaggccttcgggttgtgaacctctttcgccagtgaagcaggcctgcccctggtgggtgggttgacggtagctggataagaagcgccggctaactacgtgccagcagccgcggtaatacgtagggcgcgagcgttgtccggaattattgggcgtaaagagctcgtaggcggctggtcgcgtctgtcgtgaaatcctctggcttaactgggggcttgcggtgggtacgggccggcttgagtgcggtaggggaggctggaactcctggtgtagcggtggaatgcgcagatatcaggaagaacaccggtggcgaaggcgggtctctgggccgttactgacgctgaggagcgaaagcgtggggagcgaacaggattagataccctggtagtccacgccgcaaacgttgggcactaggtgtggggggccttttccgggttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccggtcggctccggagacggggtttcctccttgtggggccggttcacaggtggtgcatggttgtcgtcagctcgtgtcgtgagatgttgggttaagtcccgcaacgagcgcaacccttgtctcgtgttgccagcacgttgtggtggggactcgcgggagactgccggggtcaactcggaggaaggtggggatgacgtcaaatcatcatgccccttatgtcttgggcttcacgcatgctacaatggccggtacagagggttgcgatactgtgaggtggagcgaatcccttaaagccggtctcagttcggatcggtgtctgcaactcgagtgcatgaagctggaattactagtaatcgtggatcagcgtgccacggtgaatgcgttcccgggtcttgta

SEQ ID NO: 638 - DNA, 1487 bp, Artificial Sequence
  Synthetic Polynucleotide
  misc_feature (157)..(157): n is a, c, g, or t
cgaacgctggcggcgtgcttaacacatgcaagtcgaacgggatccattggtgcttgcacttttggtgagagtggcgaacgggtgagtaacacgtgagtaacctgcccttttctttgggataagcctgggaaactgggtctaatactggatgttccgncttcctcgcatggggttgttgggaaaggttttttctggattgggatgggctcgcggcttatcagcttgttggtggggtgatggcttaccaaggctttgacgggtagccggcctgagagggtggtcggtcacactgggactgagatacggcccagactcctacgggaggcagcagtgggggatattgcacaatggacgcaagtctgatgcaccgacgtcgtgtgggggatgaaggccttcgggttgtaaactcctttcgcctgcggaaaaggcagggttttggccttgttgatggtagtgggtaaagaagcgccggctcactacgtgccagcagccgcggtaatacgtagggcgcgagcgttgtccggaattattgggcgtaaagggctcgtaggcggtttgtcgcgtctagcgtttaaggctcgggcttaacccgggtttgcgttgggtacgggcaggcttgagtgcggtaggggtaactggaattcctggtgtagcggtggaatgcgcagatatcaggaggaacaccggtggcgaaggcgggttactgggccgttactgacgctgaggagcgagagcgtggggagcgaacaggattagataccctggtagtccatgctgtaaacgttgggcactaggtgtgggggctggtttcatggttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccgcgagactgcagagatgtggttgccttcggggtggtgtgcaggtggtgcatggttgtcgtcagctcgtgtcgtgagatgttggttaagtcccgcaacgagcgcaacccttgtctcatgttgccagcacgtttgggtggggactcgtgagagactgccggggttaactcggaggaaggtggggatgacgtcaaatcatgatgccccatatgtcttgggcttcacgcatgctacagtggtgtctacagagggttgctattccgtgaggttgagcgaatctcttaaagggcatcttggttcggatcgcagtctgcaactcgactgcgtgaaggtggagtcgctagtaatcgcagatgagcattgctgcggtgaatacgttctcgggccttgtacacaccgcccgtcacgtcacgaaagttggtaacacccgaagcctgtggcctaacctttttggggggagtggtcgaaggtggggctagcgattgggacgaagtcgtaacaaggtagccgtaccggaagg

SEQ ID NO: 639 - DNA, 1360 bp, Artificial Sequence; identical to SEQ ID NO: 222
  Synthetic Polynucleotide

SEQ ID NO: 640 - DNA, 1381 bp, Artificial Sequence; identical to SEQ ID NO: 216
  Synthetic Polynucleotide

SEQ ID NO: 641 - DNA, 1442 bp, Artificial Sequence; identical to SEQ ID NO: 294
  Synthetic Polynucleotide

SEQ ID NO: 642 - DNA, 1452 bp, Artificial Sequence; identical to SEQ ID NO: 230
  Synthetic Polynucleotide

SEQ ID NO: 643 - DNA, 1496 bp, Artificial Sequence; identical to SEQ ID NO: 104
  Synthetic Polynucleotide

SEQ ID NO: 644 - DNA, 1379 bp, Artificial Sequence; identical to SEQ ID NO: 211
  Synthetic Polynucleotide

SEQ ID NO: 645 - DNA, 1454 bp, Artificial Sequence
  Synthetic Polynucleotide
tcagattgaacgctggcggcatgctttacacatgcaagtcgaacggcagcacagggagcttgctcccgggtggcgagtggcgcacgggtgagtaatacatcggaacgtgtcctatcgtgggggataactgatcgaaaggttagctaataccgcataagacctgagggtgaaagcaggggatcgcaagaccttgcgcgattggagcggccgatggccgattagctagttggtgaggtaaaggctcaccaaggcgacgatcggtagctggtctgagaggacgaccagccacattgggactgagacacggcccaaactcctacgggaggcagcagtggggaattttggacaatgggggcaaccctgatccagccatgccgcgtgcaggatgaaggtcttcggattgtaaactgcttttgtcagggacgaaaaggattccgctaatatcgggatctgctgacggtacctgaagaataagcaccggctaactacgtgccagcagccgcggtaatacgtagggtgcaagcgttaatcggaattactgggcgtaaagcgtgcgcaggcggttctgtaagacggatgtgaaatccccgggctcaacctgggaattgcattcgtgactgcaggactagagtccatcagagggaggtggaattccaagtgtagcagtgaaatgcgtagatatttggaagaacaccaatggcgaaggcagcctcctgggatgtcactgacgctcatgcacgaaagcgtggggagcaaacaggattagataccctggtagtccacgccctaaacgatgtctactggttgttggggatttaatatccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcgagaacctttcagagatgagagggtgcccgcaagggaattcgaacacaggtgctgcatggctgtcgtcagctcgtgtcgtgagatgttgggttaagtcccgcaacgagcgcaacccttgtcactagttgctacgcaagagcactctagtgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattggagtctgcaactcgactccatgaagtcggaatcgctagtaatcgcggatcagcatgccgcggtgaatacgttcccgggtcttgtacacaccgcccgtcacaccatgggagtggggttcaccagaagacgtttgtctaaccgcaaggaggacggcgtccacggtgggtttcatga

SEQ ID NO: 646 - DNA, 1448 bp, Artificial Sequence; identical to SEQ ID NO: 246
  Synthetic Polynucleotide

SEQ ID NO: 647 - DNA, 1434 bp, Artificial Sequence; identical to SEQ ID NO: 305
  Synthetic Polynucleotide

SEQ ID NO: 648 - DNA, 1394 bp, Artificial Sequence; identical to SEQ ID NO: 158
  Synthetic Polynucleotide

SEQ ID NO: 649 - DNA, 1452 bp, Artificial Sequence; identical to SEQ ID NO: 261
  Synthetic Polynucleotide

SEQ ID NO: 650 - DNA, 1458 bp, Artificial Sequence; identical to SEQ ID NO: 25
  Synthetic Polynucleotide

SEQ ID NO: 651 - DNA, 1458 bp, Artificial Sequence; identical to SEQ ID NO: 262
  Synthetic Polynucleotide

SEQ ID NO: 652 - DNA, 1392 bp, Artificial Sequence; identical to SEQ ID NO: 131
  Synthetic Polynucleotide

SEQ ID NO: 653 - DNA, 1430 bp, Artificial Sequence
  Synthetic Polynucleotide
gctttacacatgcaagtcgaacggtaacgcggagggaagcttgcttctctccggcgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagcctgttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaatcacttttgtagagaacgaaaagacatcttcgaataaaggatgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcggaggcagcctcctgggacataactgacgctcaggcacgaaagcgtggggagcaaacaggattagataccctggtagtccacgccctaaacgatgttaactagttgttgggatgtaacaatctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccttgacatgtcaggaagctcttgtaatgagagcgtgcccgcaagggagcctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagcgaagccgtgaggcggagccaatcccagaaaaccgatcgtagtccggattgcagtctgcaactcgactgcatgaagtcggaatcgctagtaatcgcgcatcagccatggcgcggtgaatacgttcccgggccttgtacacaccgcccgtcaagccatgggagccgggggtacctgaagtccgtaacagggaggatcggcctagggtaaaactggtga

SEQ ID NO: 654 - DNA, 1449 bp, Artificial Sequence; identical to SEQ ID NO: 286
  Synthetic Polynucleotide

SEQ ID NO: 655 - DNA, 1447 bp, Artificial Sequence; identical to SEQ ID NO: 304
  Synthetic Polynucleotide

SEQ ID NO: 656 - DNA, 1443 bp, Artificial Sequence; identical to SEQ ID NO: 233
  Synthetic Polynucleotide

SEQ ID NO: 657 - DNA, 1506 bp, Artificial Sequence; identical to SEQ ID NO: 223
  Synthetic Polynucleotide

SEQ ID NO: 658 - DNA, 1396 bp, Artificial Sequence
  Synthetic Polynucleotide
agagtttgatcctggctcagattgaacgctggcggcatgctttacacatgcaagtcgaacggcagcacagggagcttgctcccgggtggcgagtggcgcacgggtgagtaatacatcggaacgtgtcctgttgtgggggataactgctcgaaagggtggctaataccgcatgagacctgagggtgaaagcgggggatcgcaagacctcgcgcaattggagcggccgatgcccgattagctagttggtgaggtaaaggctcaccaaggcgacaatcggtagctggtctgagaggacgaccagccacactgggactgagacacggcccagactcctacgggaggcagcagtggggaattttggacaatgggggcaaccctgatccagccatgccgcgtgcaggatgaaggccttcgggttgtaaactgcttttgtcagggacgaaaaggatcgtgataataccatggtctgctgacggtacctgaagaataagcaccggctaactacgtgccagcagccgcggtaatacgtagggtgcaagcgttaatcggaattactgggcgtaaagcgtgcgcaggcggttctgtaagacagatgtgaaatcacccgggctcaacctgggaattgcatttgtgactgcgaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacaggattagataccctggtagtccacgccctaaacgatgtctactggttgttggggtttattaaccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaatcctgaagagattcgggagtgcccgcaagggaatctggacacaggtgctgcatggctgtcgtcagctcgtgtcgtgagatgttgggttaagtcccgcaacgagcgcaacccttgtcactagttgctacgcaagagcactctagtgagactgccggtgacaaaccggaggaaggtggggatgacgtcaagtcctcatggcccttatggctagggcctcacacgtcatacaatggtcggtacagagggcagctaccctgcgaagggatgcgaatctcgaaagcctatctcagttcggattggaggctgaaacccgcctccatgaagttggattcgctagtaatcgcgcatcagccatggcgcggtgaatacgttcccgggccttgcacacaccgcccgtca

SEQ ID NO: 659 - DNA, 1448 bp, Artificial Sequence; identical to SEQ ID NO: 227
  Synthetic Polynucleotide

SEQ ID NO: 660 - DNA, 1385 bp, Artificial Sequence; identical to SEQ ID NO: 190
  Synthetic Polynucleotide
  misc_feature (730)..(730): n is a, c, g, or t
  misc_feature (787)..(787): n is a, c, g, or t

SEQ ID NO: 661 - DNA, 1421 bp, Artificial Sequence; identical to SEQ ID NO: 260
  Synthetic Polynucleotide

SEQ ID NO: 662 - DNA, 1369 bp, Artificial Sequence
  Synthetic Polynucleotide
attgaacgctggcggaacgctttacacatgcaagtcgaacggtaacgtggggaggagcttgctccgccccgacgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacaccatcgaataaatggtgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattaggtaccctggtagtccacgccctaaacgatgttaactagtggttgggatgtaacaatctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccccgacatgtcaggaagctcttgtaatgagagcgtgcccgcaagggagcctgaacacaggtgctgcatggctgtcgtcagctcgtgtcgtgagatgttgggttaagtcccgcaacgagcgcaacccttgtcactagttgttacgaaagggcactctagtgagactgccggtgacaaaccggaggaaggtggggaggacgtcaagtcctcatggcccttatgggtagggcttcacacgtcatacaatggtcggaacagagggcagcgaagccgtgaggcggagccaatcccagaaaaccgatcgtagtccggattgcagtctgcaactcgactgcatgaagtcggaatcgctagtaatcgcggatcagcatgccgcggcgaataaaatcccgggtcttgcaca

SEQ ID NO: 663 - DNA, 1455 bp, Artificial Sequence; identical to SEQ ID NO: 207
  Synthetic Polynucleotide

SEQ ID NO: 664 - DNA, 1407 bp, Artificial Sequence; identical to SEQ ID NO: 78
  Synthetic Polynucleotide

SEQ ID NO: 665 - DNA, 1451 bp, Artificial Sequence; identical to SEQ ID NO: 29
  Synthetic Polynucleotide

SEQ ID NO: 666 - DNA, 1363 bp, Artificial Sequence; identical to SEQ ID NO: 16
  Synthetic Polynucleotide

SEQ ID NO: 667 - DNA, 1447 bp, Artificial Sequence; identical to SEQ ID NO: 282
  Synthetic Polynucleotide

SEQ ID NO: 668 - DNA, 1463 bp, Artificial Sequence; identical to SEQ ID NO: 273
  Synthetic Polynucleotide

SEQ ID NO: 669 - DNA, 1488 bp, Artificial Sequence; identical to SEQ ID NO: 9
  Synthetic Polynucleotide

SEQ ID NO: 670 - DNA, 1396 bp, Artificial Sequence; identical to SEQ ID NO: 263
  Synthetic Polynucleotide

SEQ ID NO: 671 - DNA, 1485 bp, Artificial Sequence; identical to SEQ ID NO: 194
  Synthetic Polynucleotide

SEQ ID NO: 672 - DNA, 1501 bp, Artificial Sequence; identical to SEQ ID NO: 184
  Synthetic Polynucleotide

SEQ ID NO: 673 - DNA, 1455 bp, Artificial Sequence; identical to SEQ ID NO: 298
  Synthetic Polynucleotide

SEQ ID NO: 674 - DNA, 1432 bp, Artificial Sequence; identical to SEQ ID NO: 275
  Synthetic Polynucleotide

SEQ ID NO: 675 - DNA, 1401 bp, Artificial Sequence
  Synthetic Polynucleotide
agagtttgatcctggctcagattgccttctggcggcatgctttacacatgcaagtcgaacggcagcggggaagtagcttgctacttctgccggcgagtggcgaacgggtgagtacaacatcggaacgtgtccgtttgtgggggacaactgctcgaaagggtagctaataccgcataagacctgagggtgaaagtgggggatcgcaagacctcacgcgaacggagcggccgatgactgattaggtagttggtgaggtaaaggcccaccaagccgacgatcagtagctggtctgagaggacgaccagccacactggaactgagacacggtccagactcctacgggaggcagcagtggggaattttggacaatgggggcaaccctgatccagccatgccgcgtgcgggaagaaggccttcgggttgtaaaccgcttttgtcagggacgaaaagttgcaggtgaataatctgcgatgctgacggtacctgaagaataagcaccggctaactacgtgccagcagccgcggtaatacgtagggtgcaagcgttaatcggaattactgggcgtaaagcgtgcgcaggcggttgggtaagacagatgtgaaatcccccgggcttaacctgggaactgcatttgtgactgtccgactcgagtatgtcagaggggggtggaattccacgtgtagcagtgaaatgcgtagatacgtggaagaacaccgatggcgaaggcagccccctggggcaaaactgacgctcatgcacgaaagcgtggggagcaaacaggattagataccctggtagtccacgccctaaacgatgtctaccggttgttggggggtaaaaccctcagtaacgaagcaaacgcgagaagtagaccgcctggggagtacggtcgcaagattaaaactcaaaggaattgacggggacccgcacaagcggtggatgatgtggattaattcgatgcaacgcgaaaaaccttacctagccttgacatgtcggagaggagccgtaaatggcgctgtgcccgcaagggaatccgaacacaggtgctgcatggctgtcgtcagctcgtgtcgtgagatgttgggttaagtcccgcaacgagcgcaacccttgtcaccagttgctaccgcaaggagcactctggtgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgtcgcggtgaatacgttcccgggtcttgtacacaccacccgtca

SEQ ID NO: 676 - DNA, 1449 bp, Artificial Sequence; identical to SEQ ID NO: 232
  Synthetic Polynucleotide

SEQ ID NO: 677 - DNA, 1374 bp, Artificial Sequence; identical to SEQ ID NO: 215
  Synthetic Polynucleotide

SEQ ID NO: 678 - DNA, 1454 bp, Artificial Sequence; identical to SEQ ID NO: 291
  Synthetic Polynucleotide

SEQ ID NO: 679 - DNA, 1423 bp, Artificial Sequence; identical to SEQ ID NO: 236
  Synthetic Polynucleotide

SEQ ID NO: 680 - DNA, 1386 bp, Artificial Sequence; identical to SEQ ID NO: 39
  Synthetic Polynucleotide

SEQ ID NO: 681 - DNA, 1460 bp, Artificial Sequence; identical to SEQ ID NO: 195
  Synthetic Polynucleotide

SEQ ID NO: 682 - DNA, 1381 bp, Artificial Sequence; identical to SEQ ID NO: 71
  Synthetic Polynucleotide

SEQ ID NO: 683 - DNA, 1470 bp, Artificial Sequence
  Synthetic Polynucleotide
acgaacgctggcggcgtgcttaacacatgcaagtcgaacgaagatacggagcggaacccttcggggggaagatctgtagactgagtggcggacgggtgagtaacgcgtgagcaacctgcctacaagagggggacaacagctggaaacggctgctaataccgcataagaccacgctatcgcatggtagaggggtcaaagatttatcgcttgtagatgggctcgcgtcccattagctagttggtgagataacagcccaccaaggcgacgatgggtagccgacctgagagggtgatcggccacactggaactgagacacggtccagactcctacgggaggcagcagtggggaatattgggcaatgggggaaaccctgacccagcaacgccgcgtgagggaagaaggccttcgggttgtaaacctctgtccttggggacgaaggaagtgacggtacccaaggaggaagctccggctaactatgtgccagcagccgcggtaatacgtagggagcgagcgttgtccggaattactgggcgtaaagggtgcgtaggcggcctgttaagtcagatgtgaaatacccgggcttaacccggggggtgcatctgatactggcaggcttgagtgcaggagaggaaagcggaattcctagtgtagcggtgaaatgcgtagatattaggaggaacaccagtggcgaaggcggctttctggactgtaactgacgctgaggcacgaaagcgtggggagcaaacaggattagataccctggtagtccacgccgtaaacgatggatactaggtgtaggggtcaaaaagacttctgtgccgcagcaaacgcattaagtatcccgcctgggggagtacggccgcaaggctgaaactcaaaggaattgacgggggcccgcacaagcagcggagcatgtggtttaattcgaagcaacgcgaagaaccttaccaaggcttgacatcctctgacgcacatagagatatgtgttctctacggagcagagagacaggtggtgcatggttgtcgtcagctcgtgtcgtgagatgttgggttaagtcccgcaacgagcgcaacccttgtcactagttgccagcattacggatgggaactctagtgagactgccggggacaactcggaggaaggtggggacgacgtcaaatcatcatgccccttatgtcttgggctacacacgtgctacaatggccggtacaaagggcagcgaaggcgcaagccggagcgaatctcaaaaagccggtcccagttcggattgtgggctgcaacccgcccacatgaagtcggagttgctagtaatcgcgaatcagcatgtcgcggtgaatgcgttcccgggccttgtacacaccgcccgtcacaccacggaagttgggggcgcccgaagccggtggcctaaccgcaaggggggagccgtcgaaggtgaaaccaatgactggggtgaagtcgtaacaaggta

SEQ ID NO: 684 - DNA, 1378 bp, Artificial Sequence
  Synthetic Polynucleotide
agagtttgatcctggctcagggcgaacgctggtggcgtgcctaacacatgcaagtcgagcgaacggaggggcttcggccccgaagttagcggcggacgggtgagtaacgcgtgagcaatctgcctttcacagtgggataacattgagaaatcagtgctaataccgcataagaccacagcctcgcatggggcaggggtcaaaggagcaatccggtggaagatgagttcgcgtcccattagatagttggtgaggtaacggctcaccaagtcaacgatgggtagccgacctgagagggtgatcggccacattgggactgagacacggcccaaactcctacgggaggcagcagtggggaatattgggcaatgggcgcaagcctgacccagcaacgccgcgtgagggaagaaggttttcggattgtaaacctctgtcctcagggacgaagaaagtgacggtacctgaggaggaagccccggctaactacgtgccagcagccgcggtaatacgtagggggcgagcgttgtccggaattactgggcgtaaagggcgcgcaggcggccgatcaagtcagatgtgaaacccccgggcttaacctgggaactgcatttgaaactggttggcttgagtgcaggagaggaaagcggaattcctagtgtagcggtgaaatgcgtagatattaggaagaacaccagtggcgaaggcggctttctggactgcaactgacgctgaggcgcgaaagcgtggggagcgaacaggattagataccctggtagtccacgccgtaaacgatggatgctaggtgtgggaggtatcgaccccttccgtgccgcagccaacgcaataagcatcccgcctgaggagtacggccgcaaggttgaaactcaaagggattgacgggggcccgcacaagcagcggagcatgtggtttaattcgaagcaacgcgaagaaccttaccaggtcttgacatctcctgaatggcgtggaaacacgcaggcccttcggggcaggaagacaggtggtgcatggttgtcgtcagctcgtgtcgtgagatgttgggttaagtcccgcaacgagcgcaacccttatacttagttgccagcgagtgaagtcgggcactctaggtagactgccggggacaactcggaggaaggtggggacgacgtcaaatcatcatgccccttatgacctgggctacacacgtgctacaatggccgggacaaagggaagcgaaggggtaacccggagcggaacccaaaaacccggtcccagttcggattgtgggctgcaacccgcccacatgaagtcggagttgctagtaatcgtggatcagcatgccacggtgaatacgttcccgggccttgtactcaccgcccgtca

SEQ ID NO: 685 - DNA, 1509 bp, Artificial Sequence
  Synthetic Polynucleotide
gagtttgatcctggctcaggacgaacgctggcggcgtgcctaacacatgcaagtcgaacggacgagtcccttcgggggcgagttagtggcgaacgggtgagtaacgcgtgaacaacctgccttcctgagggggataacacctggaaacagatgctaataccgcataagaccacagtgccgcatgacacaggggtcaaaggagcaatccgcaggaagaggggttcgcgtcccattagctggttggcggggcaacggcccaccaaggcgacgatgggtagccgagctgagaggctgatcggccacactggaactgagacacggtccagactcctacgggaggcagcagtggggaatattgggcaatgggcgcaagcctgacccagcaacgccgcgtgagggatgaaggccttcgggttgtaaacctctgtccttggagacgaagaaagtgacggtaaccaaggaggaagccccggctaactacgtgccagcagccgcggtaatacgtagggggcgagcgttgtccggaattactgggcgtaaagggtgcgtaggcggcaatttaagttggatgtgaaatacccgggcttaacttggggggtgcattcaaaactggatagctagagtacaggagagggaagcggaattcctagtgtagcggtgaaatgcgtagatattaggaggaacaccggtggcgaaggcggctttctggactgaaactgacgctgaggcacgaaagcgtggggagcaaacaggattagataccctggtagtccacgctgtaaacgatgaatactaggtgtagggggtatagactccctctgtgccggagcaaacgcaataagtattccgcctggggagtacggccgcaaggttgaaactcaaaggaattgacgggggcccgcacaagcagcggagcatgtggtttaattcgacgcaacgcgaagaaccttaccaaggcttgacatcctactaaagtcatggaaacatgatgtcccttcgggggagtagagacaggtggtgcatggttgtcgtcagctcgtgtcgtgagatgttgggttaagtcccgcaacgagcgcaacccctgttgccagttaccagcgcgtaaaggcggggactctggtgagactgccggggacaactcggaggaaggtggggacgacgtcaaatcatcatgccccttacgtcttgggctacacacgtgctacaatggctgtaacaaagggaagcaactgggtaaccagaagcgaatctcataaaagcagtcccagttcggattgtgggctgcaacccgcccacatgaagtcsgagttgctagtaatcgcggatcagcatgccgcggtgaatacgttcccgggccttgtacacaccgcccgtcacaccatgggagttgggagcgcccgaagccggtaacttaaccgcaaggagagagccgtcgaaggcgagatcaatgactggggtgaagtcgtaacaaggtagccgtatcggaaggtgcggctggatcacctcctt

SEQ ID NO: 686 - DNA, 1428 bp, Artificial Sequence; identical to SEQ ID NO: 238
  Synthetic Polynucleotide

SEQ ID NO: 687 - DNA, 1391 bp, Artificial Sequence; identical to SEQ ID NO: 148
  Synthetic Polynucleotide

SEQ ID NO: 688 - DNA, 1344 bp, Artificial Sequence; identical to SEQ ID NO: 264
  Synthetic Polynucleotide

SEQ ID NO: 689 - DNA, 1460 bp, Artificial Sequence; identical to SEQ ID NO: 110
  Synthetic Polynucleotide

SEQ ID NO: 690 - DNA, 1485 bp, Artificial Sequence
  Synthetic Polynucleotide
agttcgatcctggctcaggacgaacgctggcggcgtgcctaacacatgcaagtcgagcggggatggtaaggagcttgcttcggaccattctagcggcggacgggtgagtaacgcgtgagcaatctgtcctgcacagggggataacacttggaaacaggtgctaataccgcataagaccacggagccgcatggcgcaggggtcaaaggagcaatccggtgcagggtgagctcgcgtcccattagatagttggcggggtaacggcccaccaagtcgacgatgggtagccgacctgagagggtgatcggccacactgggactgagacacggcccagactcctacgggaggcagcagtggggaatattgggcaatgggcgaaagccttacccagcaacgccgcgtgagggaagaaggttttcggattgtaaacctctgtcctgggggacgaaggaagtgacggtaccccgggaggaagccccggctaactacgtgccagcagccgcggtaatacgtagggggcgagcgttgtccggaattattgggcgtaaagggcgcgtagacggccgagtaagttataggtgaaagcccatctttcaaggatggaattgcctgtaatactgcctggcttgagtgcaggagagggaagcggaattcctagtgtagcggtgaaatgcgtagatattaggaggaacaccagtggcgaaggcggctttctggactgtaactgacgttgaggcgcgaaagcgtggggagcaaacaggattagataccctggtagtccacgccgtaaacgatggatgctaggtgtgggaggtatcgaccccttccgtgccggagttaacgcaataagcatcccgcctggggagtacggccgcaaggttgaaactcaaaggaattgacgggggcccgcacaagcagcggagcatgtggtttaattcgaagcaacgcgaagaaccttaccaggacttgacatccgattaaagcggtggaaacaccgtgtggcttcggccgaatcgagacaggtggtgcatggttgtcgtcagctcgtgtcgtgagatgttgggttaagtcccgcaacgagcgcaacccttatttccagttactaacaggtagagctgaggactctgaagagaccgccggggacaactcggaggaaggtggggacgacgtcaaatcatcatgccccttatgttctgggctacacacgtgctacaatggtgactacaaagagaagcgagatcgcaagatggagcggatctcaaaaaagtcatctcagttcggattgtgggctgcaacccgcccacatgaagtcggagttgctagtaatcgcggatcagcatgccgcggtgaatacgttcccgggccttgtacacaccgcccgtcacaccatgggagtttggagcacccgaagtcagtgaggtaaccgcaaggagccagctgccgaaggtgagccagatgactggggtgaagtcgtaacaaggtagcc

SEQ ID NO: 691 - DNA, 1390 bp, Artificial Sequence; identical to SEQ ID NO: 137
  Synthetic Polynucleotide

SEQ ID NO: 692 - DNA, 1343 bp, Artificial Sequence; identical to SEQ ID NO: 20
  Synthetic Polynucleotide

SEQ ID NO: 693 - DNA, 1457 bp, Artificial Sequence; identical to SEQ ID NO: 4
  Synthetic Polynucleotide

SEQ ID NO: 694 - DNA, 1355 bp, Artificial Sequence; identical to SEQ ID NO: 171
  Synthetic Polynucleotide

SEQ ID NO: 695 - DNA, 1426 bp, Artificial Sequence; identical to SEQ ID NO: 6
  Synthetic Polynucleotide

SEQ ID NO: 696 - DNA, 1424 bp, Artificial Sequence
  Synthetic Polynucleotide
  misc_feature (211)..(211): n is a, c, g, or t
  misc_feature (1109)..(1109): n is a, c, g, or t
cgctggcggcgtgcctacgcatgcaagtcgaacggagacgttgatttcggttgacgtcttagtggcgaacgggtgagtaacgcgtgaacaacctgaccttaagagggggataacaacgagaaatcgttgctaataccgcataagaccacaatgccgcatggcgaaggggtcaaaggagcaatccgcttaaggaggggttcgcgtcccattnggtagtaggtgaggtaacggctcacctagccgacgatgggtagccgagctgagaggctgatcggccacactgggactgagacacggtccagactcctacgggaggcagcagtggggaatattgggcaatgggcgcagcctgacccagcaacgccgcgtgagggaagaaggttttcggattgtaaacctctgtcgcagatgacgaaggaagtgacggtaatctgtgaggaagccccggctaactacgtgccagcagccgcggtaatacgtagggggcgagcgttgtccggaattactgggcgtaaagggagcgtaggcggtcgattaagttggatgtgaaatacccgggcttaacttggggggtgcatccaatactggttgactagagtacaggagaggaaagcggaattcctagtgtagcggtgaaatgcatagatattaggaggaacatcggtggcgaaggcggctttctggactgacactgacgctgaggctcgaaagcgtggggagcaaacaggattagataccctggtagtccacgctgtaaacgatgaatactaggtgtagggggtgtaaactccccctgtgccgcagctaacgcaataagtattccgcctggggagtacggccgcaaggttgaaactcaaaggaattgaacgggggcccgcacaagcagcggagcatgtggtttaattcgacgcaacgcgaagaaccttaccaaggcttgacatccacttaaactcatggaaacatgaggtcccttcgggggaagtgagacaggtggtgcatggttgtcgtcagctcgtgtcgtgagatgttgggttaagtcccgcaacgagcgcaacccctgttgccagttaccagcgagtaatgttggggactctggtgagactgccggngacaactcggaggaaggtggggacgacgtcaaatcatcatgccccttacgtcttgggctacacacgtgctacaatggctgtaacaaagggaagcgaccctgcaaagggaagcggatctcagaaaagcagtcccagttcggattgtgggctgcaacccgcccacatgaagtcggagttgctagtaatcgcggatcagcatgccgcggtgaatacgttcccgggccttgtacacaccgcccgtcacaccatgggagttgggagcgcccgaagccggtattctaaccgcaaggaggaagccgtctaaggcgagaccaa

SEQ ID NO: 697 - DNA, 1510 bp, Artificial Sequence; identical to SEQ ID NO: 201
  Synthetic Polynucleotide

SEQ ID NO: 698 - DNA, 1402 bp, Artificial Sequence
  Synthetic Polynucleotide
ttcgcccttagagtttgatcctggctcaggacgaacgctggcggcgtgcttaacacatgcaagtcgaacgaagttgctctttgggaagccctcgggtggaactgtgagtatacttagtggcggacgggtgagtaacgcgtgagcaatctgccctgcaatgggggacaacagttggaaacgactgctaatgccgcataagaccacgaaaccgcatggtttagaggtaaaaggattcattcgatgcaggatgagctcgcgtcccattagatagttggtgaggtaacggcccaccaagtcaacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttggggaagataatgacggtgcccaacaaggaagtgacggctaactacgtgccagcagccgcggtaatacgtagggagcaagcgttgtccggaattactgggcgtaaagggtgcgtaggtggccatgtaagtcaggtgtgaaagaccggggctcaaccccggggttgcacttgaaactgtgtggcttgagtacaggagagggaagtggaattcctagtgtagcggtgaaatgcgtagatattaggaggaacaccagtggcgaaggcgactttctggactgtaactgacactgaggcacgaaagcgtggggagcaaacaggattagataccctggtagtccacgccgtaaacgatggatactaggtgtgggggggcgatagtcctccgtgccgaagctaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgcatatagagatatatgttcccttcggggcagagagacaggtggtgcatggttgtcgtcagctcgtgtcgtgagatgttgggttaagtcccgcaacgagcgcaacccttgttgctagttgccagcacgtaaaggtgggaactctagtgagactgccggggacaactcggaggaaggtggggacgacgtcaaatcatcatgccccttatgtcttgggctacacacgtgctacaatggccggtacaaagggcagcgacctcgtaagagtaagcgaatctcaaaaagccggccccagttcggattgtgggctgcaacccgcccacatgaagtcggagttgctagtaatcgcgaatcagcatgtcgcggtgaatgcgttcccgggccttgcacacaccgcccgtca

SEQ ID NO: 699 - DNA, 1363 bp, Artificial Sequence; identical to SEQ ID NO: 177
  Synthetic Polynucleotide

SEQ ID NO: 700 - DNA, 1390 bp, Artificial Sequence
  Synthetic Polynucleotide
ttcgcccttagagtttgatcctggctcaggacgaacgctggcggcgtgcctaacacatgcaagtcgaacggagatattgaatttcggtttagtattttagtggcgcacgggtgagtaacgcgtgaacaacttgaccttcagagggggataacagcgagaaatcggtgctaataccgcatgagaccacaagcccgcatggggaaggggtcaaaggaggaatccgctgaaggagaggttcgcgtcccattaggtagttggcgggataacagcccaccaagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggctttcgggttgtaaacctctgtccttggtgacgaaggaagtgacggtagccaaggaggaagccccggctaactacgtgccagcagccgcggtaatacgtagggggcgagcgttgtccggaattactgggcgtaaagggtgcgtaggcggcggattaagttggatgtgaaatacccgggcttaacttgggggctgcatccaatactggtctgctagagtgcaggagagggaagcggaattcctagtgtagcggtgaaatgcatagatattaggaggaacaccagtggcgaaggcggctttctggactgtaactgacgctgaggcacgaaagcgtggggagcaaacagaattagataccctggtagtccacgctgtaaacgatgaataccaggtgtagggggtatcaactccccctgtgccggagcaaacgcaataagtattccgcctggggagtacggccgcaaggttgaaactcaaaggaattgacgggggcccgcacaagcagcggagcatgtggtttaattcgacgcaacgcgaagaaccttaccaaggcttgacatccacttaagcccatggaaacatggggtgccttcgggcgaagtgagacaggtggtgcatggttgtcgtcagctcgtgtcgtgagatgttgggttaagtcccgcaacgagcgcaacccctgttgccagttaccagcgggtaaagccggggactctggtgagactgccggggacaactcggaggaaggtggggacgacgtcaaatcatcatgccccttatgtcttgggctacacacgtgctacaatggctgaaacaaagggaagcgaccctgtaaggggaagcggatctcagaaaaacagtcccagttcggattgtgggctgcaacccgcccacatgaagtcggagttgctagtaatcgcggatcagcatgccgcggtgaatacgttcccgggccttgtacacaccgcccgtca

SEQ ID NO: 701 - DNA, 1495 bp, Artificial Sequence
  Synthetic Polynucleotide
ggctcaggacgaacgctggcggcgtgcttaacacatgcaagtcgaacgaggttgccctttgtgaatccttcgggaggaactgtgggtataccgagtggcggacgggtgagtaacgcgtgagcaacctgccctgcaacgggggacaacagttggaaacgactgctaataccgcatgagaccacgaaaccgcatggttttgaggtaaaaggatttattcgatgcaggatgggctcgcgtcccattagatagttggtgaggtaacggcccaccaagtcaacgatgggtagccgacctgagagggtgatcggccacactggaactgagacacggtccagactcctacgggaggcagcagtggggaatattgggcaatgggggaaaccctgacccagcaacgccgcgtgagggaagaaggtcttcggattgtaaacctttgtcctatgggacgaaagaaatgacggtaccataggaggaagctccggctaactacgtgccagcagccgcggtaatacgtagggagcaagcgttgtccggaattactgggcgtaaagggtgcgtaggtggtcatgtaagtcagatgtgaaagaccggggcttaaccccggggttgcatttgaaactgtgtgacttgagtacaggagagggaagtggaattcctagtgtagcggtgaaatgcgtagatattaggaggaacaccagtggcgaaggcgactttctggactgtaactgacactgaggcacgaaagcgtggggagcaaacaggattagataccctggtagtccacgccgtaaacgatggatactaggtgtggggcccgatagggttccgtgccgaagcaaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgactgtagagatacagtttcccttcggggcagagagacaggtggtgcatggttgtcgtcagctcgtgtcgtgagatgttgggttaagtcccgcaacgagcgcaacccttattgctagttgccagcgcgtaaaggcgggaactctagtgagactgccggggacaactcggaggaaggtggggacgacgtcaaatcatcatgccccttatgtcttgggctacacacgtgctacaatggccggtacaaagggcagcgaacccgtaaggggaagcgaatctcaaaaagccggtcccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgtaaggagagagctgtcgaaggtgagatcaatgactggggtgaagtcgtaacaaggtagccgtatcggaagg

SEQ ID NO: 702 - DNA, 1350 bp, Artificial Sequence; identical to SEQ ID NO: 18
  Synthetic Polynucleotide

SEQ ID NO: 703 - DNA, 1497 bp, Artificial Sequence
  Synthetic Polynucleotide
agagtttgatcctggctcaggacgaacgctggcggcgtgcttaacacatgcaagtcgaacgaagttgctctttgggaagccctcgggtggaactgtgagtatacttagtggcggacgggtgagtaacgcgtgagcaatctgccctgcaatgggggacaacagttggaaacgactgctaataccgcataagaccacgaaaccgcatggtttagaggtaaaaggattcattcgatgcaggatgagctcgcgtcccattagatagttggtgaggtaacggcccaccaagtcaacgatgggtagccgacctgagagggtgatcggccacattggaactgagaaacggtccaaactcctacgggaggcagcagtggggaatattgggcaatgggggaaaccctgacccagcaacgccgcgtgaaggaagaaggccttcgggttgtaaacttttgtcctatgggacgaaaaaaatgacggtaccataggaggaagctccggctaactacgtgccagcagccgcggtaatacgtagggagcaagcgttgtccggaattactgggcgtaaagggtgcgtaggtggccatgtaagtcaggtgtgaaagaccggggctcaaccccggggttgcacttgaaactgtgtggcttgagtacaggagagggaagtggaattcctagtgtagcggtgaaatgcgtagatattaggaggaacaccagtggcgaaggcgactttctggactgtaactgacactgaggcacgaaagcgtggggagcaaacaggattagataccctggtagtccacgccgtaaacgatggatactaggtgtggggggcgatagtcctccgtgccgaagctaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgcatatagagatatatgttcccttcggggcagagagacaggtggtgcatggttgtcgtcagctcgtgtcgtgagatgttgggttaagtcccgcaacgagcgcaacccttgttgctagttgccagcacgtaaaggtgggaactctagtgagactgccggggacaactcggaggaaggtggggacgacgtcaaatcatcatgccccttatgtcttgggctacacacgtgctacaatggccggtacaaagggcagcgacctcgtaagagtaagcgaatctcaaaaagccggccccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgtaaggagagagctgtcgaaggtgagatcaatgactggggtgaagtcgtaacaaggtaacc

SEQ ID NO: 704 - DNA, 1386 bp, Artificial Sequence; identical to SEQ ID NO: 154
  Synthetic Polynucleotide

SEQ ID NO: 705 - DNA, 1370 bp, Artificial Sequence; identical to SEQ ID NO: 159
  Synthetic Polynucleotide

SEQ ID NO: 706 - DNA, 1419 bp, Artificial Sequence
  Synthetic Polynucleotide
  misc_feature (1415)..(1416): n is a, c, g, or t
gacgaacgctggcggcgtgcctaacacatgcaagtcgaacggagataaagatttcggtttttatcttagtggcgcacgggtgagtaacacgtgaataacctgacccaaagagggggataacacctggaaacaggtgctaataccgcataagaccacaatgtcgcatgacgaaggggtcaaagaaaatcgctttgggaggggttcgcgtcccattaggtagtaggcggggtaacagcccacctagccgacgatgggtagccgagctgagaggctgatcggccacactggaactgagacacggtccagactcctacgggaggcagcagtggggaatattgggcaatgggcgcaagcctgacccagcaacgccgcgtgagggaagaaggttttcggattgtaaacctctgtcgcagaagacgaaggaagtgacggtattctgtgaggaagccccggctaactacgtgccagcagccgcggtaatacgtagggggcgagcgttgtccggaattactgggcgtaaagggagcgtaggcggtctgataagttggatgtgaaatacccgggcttaacttggggggtgcatccaatactgttggactagagtacaggagaggaaagcggaattcctagtgtagcggtgaaatgcatagatattaggaggaacatcggtggcgaaggcggctttctggactgcaactgacgctgaggctcgaaagcgtggggagcaaacaggattagataccctggtagtccacgctgtaaacgatgaatactaggtgtagggggtataaactccctctgtgccgcagcaaacgcaataagtattccgcctggggagtacggccgcaaggttgaaactcaaaggaattgacgggggcccgcacaagcggtggagcatgtggtttaattcgatgcaacgcgaagaaccttaccaggtcttgacatccagagaatctttaggaaactaaagagtgcctttgggaactctgagacaggtggtgcatggttgtcgtcagctcgtgtcgtgagatgttgggttaagtcccgcaacgagcgcaacccctgctattagttactaacaagtaaagttgaggactctaatgggactgcctgtgacaagcaggaggaaggtggggatgacgtcaaatcatcatgccctttatgatctgggctacacacgtgctacaatggatggtacagagagcagcgaaatcgtgaggtcaagcgaatctcaaaaagccattctcagttcggattgtagtctgcaactcgactacatgaagtcggaatcgctagtaatcgcggatcagaatgtcgcggtgaatgcgttcccgggccttgtacacaccgcccgtcacaccacgaaagctggcaacacccgaagccggtgagctagccttataggaagcagccgnngaa

SEQ ID NO: 707 - DNA, 1504 bp, Artificial Sequence; identical to SEQ ID NO: 112
  Synthetic Polynucleotide

SEQ ID NO: 708 - DNA, 1482 bp, Artificial Sequence; identical to SEQ ID NO: 191
  Synthetic Polynucleotide

SEQ ID NO: 709 - DNA, 1345 bp, Artificial Sequence; identical to SEQ ID NO: 249
  Synthetic Polynucleotide

SEQ ID NO: 710 - DNA, 1476 bp, Artificial Sequence; identical to SEQ ID NO: 192
  Synthetic Polynucleotide

SEQ ID NO: 711 - DNA, 1388 bp, Artificial Sequence; identical to SEQ ID NO: 156
  Synthetic Polynucleotide

SEQ ID NO: 712 - DNA, 1365 bp, Artificial Sequence
  Synthetic Polynucleotide
agagtttgatcctggctcaggacgaacgctggcggcgtgcttaacacatgcaagtcgaacggaggtatttatttcggtagatatcttagtggcgaacgggtgtgagtaacgcgtgagcaacctgacctaaagagggggataacattcggaaacggatgctaataccgcataagaccacattgtcacatgacagaggggtcaaaggagcaatccgctttgggaggggctcgcgtcccattaggtagttggtgaggtaacggcccaccaagcctgcgatgggtagccgagctgagaggctgaacggccacactggaactgagacacggtccagactcctacgggaggcagcagtggggaatattgggcaatgggcgcaagcctgacccagcaacgccgcgtgagggaagaaggttttcggattgtaaacctctgtccttggggacgaaaaaaatgacggtacccgaggaggaagccccggctaactacgtgccagcagccgcggtaatacgtagggggcgagcgttgtccggaattactgggcgtaaagggtgcgtaggcggtttattaagttggatgtgaaatacccgggcttaacttgggaggtgcatccaaaactggtagactagagtacaggagagggaagcggaattcctagtgtagcggtgaaatgcgtagatattaggaggaacaccagtggcgaaggcggctttctggactgacactgacgctgaggcacgaaagcgtggggagcaaacaggattagataccctggtagtccacgctgtaaacgatgaatactaggtgtagggggtatcaactccccctgtgccggagcaaacgcaataagtattccgcctggggagtacggccgcaaggttgaaactcaaaggaattgacgggggcccgcacaagcagcggagcatgtggtttaattcgaagcaacgcgaagaaccttaccaaggcttgacatcctgctaaactcatggaaacatgaggtcccttcgggggagcagagacaggtggtgcatggttgtcgtcagctcgtgtcgtgagatgttgggttaagtcccgcaacgagcgcaacccctattaccagttaccagcacgtaaaggtgggaactctggtgagactgccggggacaactcggaggaaggtggggatgacgtcaaatcatcatcccccttatgtcttgggctacacacgtgctacaatggcagttacagagggcagcgaagcggtaacgtgaagcgaatctcataaagccattctcagttcggattgcaggctgaaactcgcctgcatgaagctggagttactagtaatcgcagatcagaatgctgcggtgaatgcgttcccgggtcttg

SEQ ID NO: 713 - DNA, 1492 bp, Artificial Sequence; identical to SEQ ID NO: 109
  Synthetic Polynucleotide

SEQ ID NO: 714 - DNA, 1456 bp, Artificial Sequence
  Synthetic Polynucleotide
gacgaacgctggcggcatgcttaacacatgcaagtcgaacggagatctgcagaaaagcttgcttggaaacagatcttagtggcggacgggtgagtaacgcgtgaggaacctggctcacacagggggataacatagggaaacttatgctaataccgcatgagaccacgctatcgcatggtagaggggtcaaaggagcaatccggtgtgaggtggactcgcgtcctattagatagttggtggggtaacggcccaccaagtcgacgataggtagccgagctgagaggctgatcggccacattgggactgagacacggcccaaactcctacgggaggcagcagtggggaatattgggcaatgggcgcaagcctgacccagcaatgccgcgtgagagaagaaggttttcggattgtaaatctctgtcctaagggaagaagaaagtgacggtaccttaggaggaagccccggctaactacgtgccagcagccgcggtaatacgtagggggcaagcgttgtccggaattactgggcgtaaagggcgcgtaggcggcctgccaagtcttgtgtgaaaaccctggtttcaagccaggaggtgcacgggaaactggcgggcttgagtgcaggagagggaagtggaattccaagtgtagcggtgaaatgcgtagagatttggaggaacaccagtggcgaaggcgactttctggactgtaactgacgctgaggcgcgaaagcgtggggagcaaacaggattagataccctggtagtccacgccgtaaacgatgaatgctaggtgtaggaggtatcgaccccttctgtgccgcagttaacacaataagcattccgcctggggagtacggccgcaaggttgaaactcaaaggaattgacgggggcccgcacaagcagcggagcatgttgtttaattcgacgcaacgcgaagaaccttaccaggtcttgacatccacggaattttgtggaaacacgaaagtgccctttcggggagccgtgagacaggtggtgcatggttgtcgtcagctcgtgtcgtgagatgttgggttaagtcccgcaacgagcgcaacccttgtgaatagttactaacgggtaaagccgaggactctattgagactgccggggacaactcggaggaaggtggggacgacgtcaaatcatcatgccccttatgatctgggctacaaacgtgctacaatggccgttacaaagggaagcgacactgtaaggtgaagcggatcccaaaaaagcggtctcagttcggatcgtgggctgcaacccgcccacgtgaagttggagttgctagtaatcgcgaatcagtatgtcgcggtgaatacgttcccgggccttgtacacaccgcccgtcacaccatgggagtttagagcacccgaagtcagtggggtaaccgcaaggagccagctgccgaaggtgagctagatgactggggtg

SEQ ID NO: 715 - DNA, 1376 bp, Artificial Sequence
  Synthetic Polynucleotide
ttcgcccttagagtttgatcctggctcaggacgaacgctggcggcacgcctaacacatgcaagtcgagcgagaacttcggttctagcggcggacgggtgagtaacacgtgagcaacctgcctttcagagggggacaacagttggaaacgactgctaataccgcataatgtcatttggcggcatcgttgaatgaccaaaggagcaatccgctgaaagatgggctcgcgtccaattagatagttggtggggtaacggcctaccaagtcgacgattggtagccggactgagaggttgaacggccacattgggactgagatacggcccagactcctacgggaggcagcagtggggaatattgcacaatgggggaaaccctgatgcagcaacgccgcgtaaaggaagacggtcttcggattgtaaacttttgttcttggtgaagaagcaagtgacggtagccaaggaggaagccacggctaactacgtgccagcagccgcggtaatacgtaggtggcaagcgttgtccggaattactgggcgtaaagggtgcgtaggcggtttggtaagttggatgtgaaatacccgggcttaacttgggggctgcatccaatactgtcggacttgagtgcaggagaggaaagcggaattcctagtgtagcggtgaaatgcgtagatattaggaggaacaccggtggcgaaggcggctttctggactgtaactgacgctgaggcacgaaagcgtggggagcaaacaggattagataccctggtagtccacgccgtaaacgatgaatactaggtgtagggggtatagactccctctgtgccgcagcaaacgcaataagtattccgcctggggagtacggccgcaaggttgaaactcaaaggaattgacgggggcccgcacaagcagcggagcatgtggtttaattcgacgcaacgcgaaaaaccttaccaagacttgacatcctactaaactcatggaaacatgaggtgacttcggtcgagtagagacaggtggtgcatggttgtcgtcagctcgtgtcgtgagatgttgggttaagtcccgcaacgagcgcaacccctgttgccggttaccagcgagtaaagtcgggggctccggtgagactgccgaggacaactcggaggaaggtggggacgacgtcaaatcatcatgccccttacgtcttgggctacacacgtgctacaatggctgtaacaaagggaagcgacagcgtaagctgaagcggatctcgaaaaggcagtcccagttcggattgtgggctgcaacccgcccacatgaagtcggagttgctagtaatcgcggatcagcatgccgcggtgaatacgttcccgggccttgcacacaccgcccgtca

SEQ ID NO: 716 - DNA, 1383 bp, Artificial Sequence; identical to SEQ ID NO: 52
  Synthetic Polynucleotide

SEQ ID NO: 717 - DNA, 1344 bp, Artificial Sequence
  Synthetic Polynucleotide
gacgaacgctggcggcgtgcctaatacatgcaagtcgagcggagttgagttgagtacttgtacgagacttagcttagcggcggacgggtgagtaacgcgtgagcgacctggcctatacagggggataacagagagaaatttctgctaataccgcataagaccacagcactgcatggtacaggggtcaaaggagagattcggtataggatgggctcgcgtcccattagctagttggaggtgtaacggaccaccaaggcgacgatgggtagccgacctgagagggtgaccggccacactgggactgagacacggcccagactcctacgggaggcagcagtagggaatattggacaatggggggaaccctgatccagcaacgccgcgtgaaggaagaaggtcttcggattgtaaacttatgttgtcggggacgaaaagagacggtacccgacgaggaagccccggctaactacgtgccagcagccgcggtaatacgtagggggcgagcgttgtccggagttactgggcgtaaagggcgcgtaggcggcatattaagttagatgtgaaatccccgggcttaacctgggtgttgcatttaaaactgataagcttgagtgcaggagagggaagcggaattcctagtgtagcggtggaatgcgtagatattaggaggaacaccagtggcgaaggcggctttctggactgtaactgacgctgaggcgcgagagcgtggggagcaaacaggattagataccctggtagtccacgccgtaaacgatggatactaggtgtagagggtatcgaccccctctgtgccggagcaaacgcaataagtatcccgcctggggagtacggccgcaaggttgaaactcaaaggaattgacgggggcccgcacaagcagcggagcatgtggtttaattcgaagcaacgcgaagaaccttaccaaggcttgacatcctctgacgatgatagagatatcatttcccttcggggcagggagacaggtggtgcatggttgtcgtcagctcgtgtcgtgagatgttgggttaagtcccgcaacgagcgcaacccttgtatacagttaccagtattaagttagggactctgtatagactgccgtggataacacggaggaaggtggggacgacgtcaaatcatcatgccccttatgtcttgggctacacacgtgctacaatggccgcaacagagggcagcgagagggtaacctggagcgaatctcaaaaaagcggtctcagttcagattgtgggctgcaacccgcccacatgaagacggagttgctagtaatcgcggatcagcatgccgcggtgaatgcgttcccgggcct

SEQ ID NO: 718 - DNA, 1357 bp, Artificial Sequence; identical to SEQ ID NO: 198
  Synthetic Polynucleotide

SEQ ID NO: 719 - DNA, 1385 bp, Artificial Sequence; identical to SEQ ID NO: 60
  Synthetic Polynucleotide

SEQ ID NO: 720 - DNA, 1400 bp, Artificial Sequence; identical to SEQ ID NO: 33
  Synthetic Polynucleotide

SEQ ID NO: 721 - DNA, 1504 bp, Artificial Sequence; identical to SEQ ID NO: 15
  Synthetic Polynucleotide

SEQ ID NO: 722 - DNA, 1396 bp, Artificial Sequence; identical to SEQ ID NO: 59
  Synthetic Polynucleotide

SEQ ID NO: 723 - DNA, 1389 bp, Artificial Sequence; identical to SEQ ID NO: 65
  Synthetic Polynucleotide

SEQ ID NO: 724 - DNA, 1388 bp, Artificial Sequence; identical to SEQ ID NO: 44
  Synthetic Polynucleotide

SEQ ID NO: 725 - DNA, 1350 bp, Artificial Sequence; identical to SEQ ID NO: 85
  Synthetic Polynucleotide

SEQ ID NO: 726 - DNA, 1343 bp, Artificial Sequence; identical to SEQ ID NO: 203
  Synthetic Polynucleotide
  misc_feature (914)..(916): n is a, c, g, or t

SEQ ID NO: 727 - DNA, 1400 bp, Artificial Sequence; identical to SEQ ID NO: 54
  Synthetic Polynucleotide

SEQ ID NO: 728 - DNA, 1410 bp, Artificial Sequence; identical to SEQ ID NO: 7
  Synthetic Polynucleotide
  misc_feature (12)..(12): n is a, c, g, or t

SEQ ID NO: 729 - DNA, 1405 bp, Artificial Sequence; identical to SEQ ID NO: 599
  Synthetic Polynucleotide

SEQ ID NO: 730 - DNA, 1398 bp, Artificial Sequence; identical to SEQ ID NO: 271
  Synthetic Polynucleotide

SEQ ID NO: 731 - DNA, 1415 bp, Artificial Sequence; identical to SEQ ID NO: 601
  Synthetic Polynucleotide
  misc_feature (892)..(892): n is a, c, g, or t

SEQ ID NO: 732 - DNA, 1419 bp, Artificial Sequence; identical to SEQ ID NO: 602
  Synthetic Polynucleotide

SEQ ID NO: 733 - DNA, 1401 bp, Artificial Sequence; identical to SEQ ID NO: 603
  Synthetic Polynucleotide

SEQ ID NO: 734 - DNA, 1367 bp, Artificial Sequence; identical to SEQ ID NO: 217
  Synthetic Polynucleotide

SEQ ID NO: 735 - DNA, 1395 bp, Artificial Sequence; identical to SEQ ID NO: 605
  Synthetic Polynucleotide

SEQ ID NO: 736 - DNA, 1417 bp, Artificial Sequence; identical to SEQ ID NO: 606
  Synthetic Polynucleotide

SEQ ID NO: 737 - DNA, 1521 bp, Artificial Sequence; identical to SEQ ID NO: 607
  Synthetic Polynucleotide

SEQ ID NO: 738 - DNA, 1494 bp, Artificial Sequence
  Synthetic Polynucleotide
gacgaacgctggcggcgtgcttaacacatgcaagtcgaacgatgatgcctgcaacttgttgtgggtggattagtggcgaacgggtgagtaatacgtgagtaacctgccctcctttttgggataagccttggaaacggggtctaataccgaatattctggatgattcgcatggattgtttgggaaagcttttgtgaagggggatgggctcgcggcctatcagcttgttggtggggtgatggcctaccaaggcggtgacgggtagccggcctgagagggtgaccggccacattgggactgagatacggcccagactcctacgggaggcagcagtgggggatattgcacaatgggcgaaagcctgatgcagcgacgccgcgtgggggatgaaggctttcgggttgtaaacctctttcgctatcgaacaaggctcactttttggtgggttgagggtaggtggagaagaagcgccggctaactacgtgccagcagccgcggtaatacgtagggcgcgagcgttgtccggaattattgggcgtaaagggcttgtaggcggcttgttgcgcctgctgtgaaaacgcggggcttaacttcgcgcgtgcagtgggtacgggcaggcttgagtgtggtaggggtgactggaattccaggtgtagcggtggaatgcgcagatatctggaggaacaccgatggcgaaggcaggtcactgggccattactgacgctgaggagcgaaagcatgggtagcgaacaggattagataccctggtagtccatgctgtaaacgttgggaactaggtgtggggggcctttccaggttttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacactgcggggctgcagagatgtggtcgcatttagttggtggtgtacaggtggtgcatggttgtcgtcagctcgtgtcgtgagatgttgggttaagtcccgcaacgagcgcaacccttgtctcgtgttgccagcatgttgtggtggggactcacgagagactgccggggttaactcggaggaaggtggggatgacgtcaaatcatcatgccccttatgtcttgggcttcacgcatgctacaatggccggtacagagggttgcgatatcgtgaggtggagcgaatcccttaaagctggtctcagttcggatcggggtctgcaactcgacctcgtgaagtcggagtcgctagtaatcgcggatcagcattgccgcggtgaatacgttcccgggccttgtacacaccgcccgtcacgtcacgaaagttggtaacacccgtagctcgtggcctaaccattttttggggggagcggtcgaaggtggggctggcgattgggacgaagtcgtaacaaggtagccgtaccggaagg

SEQ ID NO: 739 - DNA, 1400 bp, Artificial Sequence; identical to SEQ ID NO: 270
  Synthetic Polynucleotide

SEQ ID NO: 740 - DNA, 1549 bp, Artificial Sequence; identical to SEQ ID NO: 608
  Synthetic Polynucleotide

SEQ ID NO: 741 - DNA, 1413 bp, Artificial Sequence; identical to SEQ ID NO: 267
  Synthetic Polynucleotide

SEQ ID NO: 742 - DNA, 1442 bp, Artificial Sequence; identical to SEQ ID NO: 277
  Synthetic Polynucleotide

SEQ ID NO: 743 - DNA, 1526 bp, Artificial Sequence; identical to SEQ ID NO: 611
  Synthetic Polynucleotide

SEQ ID NO: 744 - DNA, 1543 bp, Artificial Sequence; identical to SEQ ID NO: 612
  Synthetic Polynucleotide

SEQ ID NO: 745 - DNA, 1371 bp, Artificial Sequence; identical to SEQ ID NO: 613
  Synthetic Polynucleotide

SEQ ID NO: 746 - DNA, 1356 bp, Artificial Sequence
  Synthetic Polynucleotide
gacgaacgctggcggcgtgcttaacacatgcaagtcgaacgggatccgggctttcgggtttggtgagagtggcgaacgggtgagtaacacgtgagtaacctgcccccttctttgggataacgtcgggaaatcggcgctaatactggatattcttgctgcatcgcatggtgtggtttggaaagggtttctggtgggggatgggctcgcggcctatcagcttgttggtggggtgatggcctaccaaggctttgacgggtagccggcctgagagggtgtccggccacactgggactgagacacggcccagactcctacgggaggcagcagtggggaatattgcacaatgggcgcaagcctgatgcagcgacgccgcgtgagggatgacggccttcgggttgtaaacctctttcagtatggaacaaggatccttcttttggggggtttgagggtacgtgcagaagaagcgccggctaactacgtgccagcagccgcggtaatacgtagggcgcgagcgttgtccggatttattgggcgtaaagagctcgtaggcggtttgtcgcgtctgccgtgaaatttcctggcttaactgggagcgtgcggtgggtacgggcagactggagtgcggtaggggagactggaattcctggtgtagcggtggaatgcgcagatatcaggaggaacaccggtggcgaaggcgggtctctgggccgttactgacgctgaggagcgaaagcatggggagcgaacaggattagataccctggtagtccatgctgtaaacgttgggaactaggtgtggggtccatttccacggattctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacattcgtagttcccagagatgggggtgccgtaaggcgggtgtacaggtggtgcatggttgtcgtcagctcgtgtcgtgagatgttgggttaagtcccgcaacgagcgcaacccttgttccatgttgccagcgggttatgccggggactcatgggagactgccggggtcaactcggaggaaagcggggatgacgtcaaatcatcatgccccttatgtcttgggcttcacgcatgctacaatggccggtacagagggttgcgatctcgtgagggtgagcgaatcccgtaaagccggtctcagttcggattggggtctgcaactcgaccccatgaagttggagtcgctagtaatcgcagatcagcaacgctgcggtgaatacgttctcgggcct

SEQ ID NO: 747 - DNA, 1429 bp, Artificial Sequence; identical to SEQ ID NO: 276
  Synthetic Polynucleotide
  misc_feature (758)..(758): n is a, c, g, or t

SEQ ID NO: 748 - DNA, 1436 bp, Artificial Sequence; identical to SEQ ID NO: 615
  Synthetic Polynucleotide

SEQ ID NO: 749 - DNA, 1405 bp, Artificial Sequence; identical to SEQ ID NO: 616
  Synthetic Polynucleotide

SEQ ID NO: 750 - DNA, 1364 bp, Artificial Sequence; identical to SEQ ID NO: 617
  Synthetic Polynucleotide

SEQ ID NO: 751 - DNA, 1365 bp, Artificial Sequence; identical to SEQ ID NO: 618
  Synthetic Polynucleotide

SEQ ID NO: 752 - DNA, 1361 bp, Artificial Sequence
  Synthetic Polynucleotide
gatgaacgctggcggcgtgcttaacacatgcaagtcgaacgggatccaaggggtgcttgcactttttggtgagagtggcgaacgggtgagtaacacgtgagtaacctgtccttttctttgggataagcattcgaaagggtgtttaataccttatgttctgtctgcctcgcatggggtgggtgggaaaggctttggccggatttgggtgggctcgcggtctatcagcttgttggtggggtgatggcttaccaaggctttgacgggtagccggcctgagagggtggtcggtcacattgggactgagatacggcccagactcctgcgggaggcagcagtgggggatattgcacaatgggcgaaagcctgatgcagcgacgccgcgtgggggatgaaggccttcgggttgtaaacttcttttgctctgaacaaggcgcactagtgggtgtgttgagtgtaggggttgattagcgccggctaactacgtgccagcagccgcggtaatacgtagggcgcgagcgttgtccggaattattgggcgtaaagggcttgtaggtggctggttgcgtctgtcgtgaaagctcatggcttaactgtgggtttgcggtgggtacgggctggcttgagtgcagtaggggaggctggaattcctggtgtagcggtggaatgcgcagatatcaggaggaataccggtggcgaaggcgggtctctgggctgttactgacactgaggagcgaaagcatggggagcgaacaggattagataccctggtagtccatgctgtaaacgttgggcactaggtgtggggaacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgcatcagagatggtgtttcccttcggggctggtatacaggtggtgcatggttgtcgtcagctcgtgtcgtgagatgttgggttaagtcccgcaacgagcgcaaccctcgttctatgttgccagcacgttatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggcct

SEQ ID NO: 753 - DNA, 1397 bp, Artificial Sequence; identical to SEQ ID NO: 189
  Synthetic Polynucleotide

SEQ ID NO: 754 - DNA, 1542 bp, Artificial Sequence
  Synthetic Polynucleotide
ttttgttggagagtttgatcctggctcaggacgaacgctggcggcgtgcttaacacatgcaagtcgaacgatgaagccgcagcttgctgtggtggattagtggcgaacgggcgagtaacacgtgagtaacctgtccttttctttgggataacggctggaaacggctgctaatactggatattcaggctgcatcgcatggtgtggtttggaaaggttttttctggaatggggtgggctcgcggcctatcagcttgttggtggggtgatggcttaccaaggctttgacgggtagccggcctgagagggtggtcggtcgcactgggactgagatacggcccagactcctacgggaggcagcagtggggaatattgcacaatggacggaagtttgatgcagcgacgccgcgtggagggtgtaggccttcgggttgtgaactcctttttctcgtgaaaaaggcatgcttttgggtgtgttgatggtagcgggggaagaagcgccggctaactacgtgccagcagccgcggtaatacgtagggcgcgagcgttgtccggatttattgggcgtaaagagctcgtaggtggttcgtcgcgtctgtcgtgaaagccagcagcttaactgttggtctgcggtgggtacgggcgggcttgagtgcggtaggggtgactggaattcctggtgtagcggtggaatgcgcagatatcaggaggaacaccgatggcgaaggcaggtcactgggccgttactgacgctgaggagcgaaagcgtggggagcgaacaggattagataccctggtagtccacgctgtaaacgttgggaactaggtgtggggatgctatcctgtgtttctgcgccgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacactgcgacatgccagagatggtgtggccttcggggtggtgtacaggtggtgcatggttgtcgtcagctcgtgtcgtgagatgttgggttaagtcccgcaacgagcgcaacccttgcctcatgttgccagcacgttatggtggggactcgtgagggactgccggggttaactcggaggagggtggggatgacgtcaaatcatcatgccccttatgtcttgggcttcacgcatgctacaatggccagtacagagggttgcgataccgtgaggtggggctaatctcttaaagctggtctcggttcggattggggtctgcaactcgaccccatgaagttggagtcgctagtaatcgcagatcagcattgctgcggtgaatacgttctcgggccttgtacacaccgcccgtcacgtcacgaaagttggtaacacccgaagcccgtggcctagcctttttggggggagcggtcgaaggtgggattggcgattgggacgaagtcgtaacaaggtagccgtaccggaaggtgcggctggatcacctcctttct

SEQ ID NO: 755 - DNA, 1503 bp, Artificial Sequence; identical to SEQ ID NO: 620
  Synthetic Polynucleotide

SEQ ID NO: 756 - DNA, 1421 bp, Artificial Sequence; identical to SEQ ID NO: 621
  Synthetic Polynucleotide

SEQ ID NO: 757 - DNA, 1526 bp, Artificial Sequence; identical to SEQ ID NO: 622
  Synthetic Polynucleotide

SEQ ID NO: 758 - DNA, 1546 bp, Artificial Sequence; identical to SEQ ID NO: 12
  Synthetic Polynucleotide

SEQ ID NO: 759 - DNA, 1367 bp, Artificial Sequence; identical to SEQ ID NO: 624
  Synthetic Polynucleotide

SEQ ID NO: 760 - DNA, 1400 bp, Artificial Sequence
  Synthetic Polynucleotide
gagtttgatcatggctcaggacgaacgctggcggcgtgcttaacacatgcaagtcgaacggaaaggcccccacttttttggtgggggtgctcgagtggcgaacgggtgagtaacacgtgggtgatctgccctgcacttcgggataagcttgggaaactgggtctaataccggataggaccatggtttagtgtctcatggtggaaagattattgttttggtgcaggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgttagggacgaagccgcactttttttgggtgtggtgacggtacctttgttaagaagcaccggctaactacgtgccagcagccgcggtaatacgtagggtgcgagcgttgtccggaattactgggcgtaaagagctcgtaggcggcttgtcgcgtctgctgtgaaaatgcggggcttaactccgtacgtgcagtgggtacgggcaggctagagtgcggtaggggtgactggaattcctggtgtagcggtggaatgcgcagatatcaggaggaacaccgatggcgaaggcaggtcactgggctgttactgacgctgaggagcgaaagcgtggggagcgaacaggattagataccctggtagtccatgctgtaaacgttgggaactaggtgtggggttctttccacggattctgcgccggagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacgctgggacggtgcagagatgtgctggcttttgctggtgtacaggtggtgcatggttgtcgtcagctcgtgtcgtgagatgttgggttaagtcccgcaacgagcgcaacccttgtctcgtgttgccagcaggttgggctggggactcacgggagactgccggggttaactcggaggaaggtggggatgacgtcaaatcatcatgccccttatgtcttgggcttcacgcatgctacaatggccggtacagagggttgcgatatcgtgaggtggagcgaatcccttaaagtcggtctcagttcggatcggggtctgcaactcgaccccgtgaagtcggagtcgctagtaatcgcggatcagcaacgccgcggtgaatacgttctcgggccttgtacacaccgcccgtc

SEQ ID NO: 761 - DNA, 1471 bp, Artificial Sequence
  Synthetic Polynucleotide
tggcggcgtgcttaacacatgcaagtcgaacggaaaggcctcaagcttgcttggggtactcgagtggcgaacgggtgagtaatacgtgagtaacctgccttcttctttgggataagcctgggaaactgggtctaatactggatattctgcttctgccgcatggtgggggttggaaaggtttttctggtgggggatgggctcacggcctatcagcttgttggtggggtgatggcctaccaaggcggtgacgggtagccggcctgagagggtgaccggccacattgggactgagatacggcccagactcctacgggaggcagcagtggggaatattgcacaatggacggaagtctgatgcagcgacgccgcgtgggggatgaaggctttcgggttgtaaactccttttgatgctgaacaaggctctttttagggttgagggtaggtgttgaataagcgccggctaactacgtgccagcagccgcggtaatacgtagggcgcgagcgttgtccggaattattgggcgtaaagggctcgtaggcggtttgtcgcgtctgctgtgaaagaccggggcttaactccggggttgcagtgggtacgggcagactagagtgcggtaggggtagctggaattcctggtgtagcggtggaatgcgcagatatcaggaggaacaccgatggcgaaggcaggttactgggccgttactgacgctgaggagcgaaagcatggggagcgaacaggattagataccctggtagtccatgctgtaaacgttggacactaggtgtggggccttttccatgggttctgcgccgtagctaacgcattaagtgtcccgcctggggagtacggtcgcaaggctaaaactcaaaggaattgacggggacccgcacaagcggcggagcatgcggattaattcgacgcaacgcgaagaaccttaccaaggcttgacatacactggaagactgcagagatgtggttgccttcgggctggtgtacaggtggtgcatggttgtcgtcagctcgtgtcgtgagatgttgggttaagtcccgcaacgagcgcaacccttgtcttgtgttgccatcacttcgggtggggactcacgagagactgccggggttaactcggaggaaggtggggatgacgtcaaatcatcatgccccttatgtcttgggcttcacgcatgctacattggctggtacagagggttgcgatatcgtgaggtggagcgaatcccttaaagctagtcttggttcggattggggtctgcaactcgaccccatgaagtcggagtcgctagtaatcgcagatcagcaacgctgcggtgaatacgttctcgggtcttgtacacaccgcccgtcacgtcacgaaagttggtaacacccgaagctcatggcttaaccacgtttgtgggtggagtggtcgaaggtgggactggcgattgggacgaagtcgtaacaaggtagccgta

SEQ ID NO: 762 - DNA, 1430 bp, Artificial Sequence; identical to SEQ ID NO: 625
  Synthetic Polynucleotide

SEQ ID NO: 763 - DNA, 1544 bp, Artificial Sequence; identical to SEQ ID NO: 14
  Synthetic Polynucleotide

SEQ ID NO: 764 - DNA, 1506 bp, Artificial Sequence; identical to SEQ ID NO: 627
  Synthetic Polynucleotide

SEQ ID NO: 765 - DNA, 1437 bp, Artificial Sequence
  Synthetic Polynucleotide
ttaacatatacaagtagaacgggatacgaaggggcttgagtttttggtgagagtggcgaacgggtgagtaacacgtgagtaacctgtccttttctctgggataagcttccgaaagggtgtttaataccttatgttctgtctgcctcgcatggggtgggtgggaaagattttttcggtaaagggtgggctcgcggtctatcagcttgttggtggggtgatggcctaccaaggctttgacgggtagccggcctgagagggtggtcggtcacattgggactgagatacggcccagactcctgcgggaggcagcagtgggggatattgcacaatgggcgaaagcctgatgcagcgacgccgcgtgggggatgaaggccttcgggttgtaaacttcttttgctctgaacaaggcgcaccgtggggtgtgttgagtgtaggggttgattagcgccggctaactacgtgccagcagccgcggtaatacgtagggcgcgagcgttgtccggaattattgggcgtaaagggcttgtaggtggctggttgcgtctgtcgtgaaagctcatggcttaactgtgggtttgcggtgggtacgggctggcttgagtgcagtaggggaggctggaattcctggtgtagcggtggaatgcgcagatatcaggaggaataccggtggcgaaggcgggtctctgggctgttactgacactgaggagcgaaagcatggggagcgaacaggattagataccctggtagtccatgctgtaaacggtgggaactgggtgtggggggcttttttgtcttctgcgtcgtagctaacgcgttaagttccccgcctggggagtacggtcgcaaggctaaaactcaaaggaattgacgggggcccgcacaagcggcggagcatgcggattaattcgatgcaacgcgaagaaccttaccaaggcttgacatgcactggaccgatccagagatgggttttcctttttggctggtgtgcaggtggtgcatggttgtcgtcagctcgtgtcgtgagatgttgggttaagtcccgcaacgagcgcaacccttgtcctatgttgccagcaagttgtgttggggactcgtgggagactgccggggttaactcggaggaaggtggggatgacgtcaaatcatcatgccccttatgtcttgggcttcacgcatgctacattggcgtctacagagggttgcgataccgtaaggtggggcgaatctcttaaagggcgtcttggttcggatcggggtctgcaactcggccccgtgaaggtggagtcgctagtaatcgcagatcagcaacgctgcggtgaatacgttctcgggccttgtacacaccgcccgtcacgtcacgaaagttggtaacactcgaagctttgtggctaacttcttttgaaggggaacgggtgaaggtggggctagcgattggg

SEQ ID NO: 766 - DNA, 1498 bp, Artificial Sequence; identical to SEQ ID NO: 279
  Synthetic Polynucleotide

SEQ ID NO: 767 - DNA, 1358 bp, Artificial Sequence; identical to SEQ ID NO: 220
  Synthetic Polynucleotide

SEQ ID NO: 768 - DNA, 1540 bp, Artificial Sequence; identical to SEQ ID NO: 630
  Synthetic Polynucleotide

SEQ ID NO: 769 - DNA, 1420 bp, Artificial Sequence; identical to SEQ ID NO: 268
  Synthetic Polynucleotide
  misc_feature (779)..(779): n is a, c, g, or t

SEQ ID NO: 770 - DNA, 1388 bp, Artificial Sequence; identical to SEQ ID NO: 1
  Synthetic Polynucleotide
  misc_feature (7)..(7): n is a, c, g, or t
  misc_feature (407)..(408): n is a, c, g, or t
  misc_feature (728)..(728): n is a, c, g, or t

SEQ ID NO: 771 - DNA, 1416 bp, Artificial Sequence; identical to SEQ ID NO: 633
  Synthetic Polynucleotide

SEQ ID NO: 772 - DNA, 1358 bp, Artificial Sequence; identical to SEQ ID NO: 218
  Synthetic Polynucleotide

SEQ ID NO: 773 - DNA, 1467 bp, Artificial Sequence; identical to SEQ ID NO: 196
  Synthetic Polynucleotide

SEQ ID NO: 774 - DNA, 1401 bp, Artificial Sequence; identical to SEQ ID NO: 636
  Synthetic Polynucleotide

SEQ ID NO: 775 - DNA, 1532 bp, Artificial Sequence; identical to SEQ ID NO: 13
  Synthetic Polynucleotide

SEQ ID NO: 776 - DNA, 1396 bp, Artificial Sequence; identical to SEQ ID NO: 637
  Synthetic Polynucleotide

SEQ ID NO: 777 - DNA, 1487 bp, Artificial Sequence; identical to SEQ ID NO: 638
  Synthetic Polynucleotide
  misc_feature (157)..(157): n is a, c, g, or t

SEQ ID NO: 778 - DNA, 1360 bp, Artificial Sequence; identical to SEQ ID NO: 222
  Synthetic Polynucleotide

SEQ ID NO: 779 - DNA, 1413 bp, Artificial Sequence
  Synthetic Polynucleotide
ggatgaacgctggcggcgcgcctaacacatgcaagtcgaacggcacccctcctcggagggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgtgcagatatcgggtggaacaccggtggcgaaggcggccctctgggccgagaccgacgctgaggcgcgaaagctgggggagcgaacaggattagataccctggtagtcccagccgtaaacgatggacgctaggtgtgagggggcgatccttccgtgccgcagccaacgcattaagcgtcccgcctggggagtacggcggcaaggctaaaactcaaaggaattgacgggggcccgcacaagcagcggagcatgtggcttaattcgaagcaacgcgaagaaccttaccagggcttgacatgaccgtgaagccggggagacccggtggccgagaggagcggtcacaggtggtgcatggctgtcgtcagctcgtgtcgtgagatgtttggttaagtccagcaacgagcgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccttgaaagccggccccagttcggattgggggctgcaacccgcccccatgaagtcggagttgctagtaatcgcggatcagcatgccgcggtgaatgcgttcccgggctttgtacactccgcccgtcacaccacccgagtcgtctgcacccgaagtcgccggcccaacctcaaggggggaggctctgaaggtgtgg

SEQ ID NO: 780 - DNA, 1386 bp, Artificial Sequence; identical to SEQ ID NO: 183
  Synthetic Polynucleotide

SEQ ID NO: 781 - DNA, 1458 bp, Artificial Sequence
  Synthetic Polynucleotide
agagtttgatcctgcctcaggatgaacgctggcggcgcgcctaacacatgcaagtcgaacggcacccgccctcgggcggaagcgagtgcggaacggctgagtaacacgtggagaacccgccccctcctccgggatagccccgggaaaccgtgggtaataccggatgaccccggcagccgcatggccggccggccaaagcccagacgggaggggatgctccgcggcccatcaggtagacggcggggtgacggcccaccgtgccgacgacgggtagccgggttgagagaccgaccggccagattgggactgagacacggcccagactctacgggaggcagcagtggggaatcttgcgcaatggggggaaccctgacgcaccgacgcccgtgcgggacgaaggccctcgggtcgtaaaccgctttcagcagggatgagacaagcggtacctgcagaagaagccccggctaactacgtgccagcagccgcggtaatacgtagggggcgaccgttatccggattcattggccgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaagggcctctgggccgagaccgacgctgaggcgcgaaagctgggggagcgaacaggattagataccctggtagtcccagccgtaaacgatggacgctaggtgtgggaggggaacccttccgtgccgcagccaacgcattaacgtcccgcctggggagtacggccgcaagctaaaactcaaaggaattgacgggggcccgcacaagcggagcggagcatgtggcttaattcgaagcaacgcgaagaaccttaccagggcttgacatgcgcgtgaagccggggagacccggtggccgagaggagcgcgcacaggtggtgcatggctgtcgtcagctcgtgtcgtgagatgtttggttaagtccagcaacgagcgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgagcggagcggatccctgaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcggcggcccaaccgagaggggggaggcgcctaaggtgtggagggtgaggggggtgaagtcgtaacaaggtaacc

SEQ ID NO: 782 - DNA, 1339 bp, Artificial Sequence; identical to SEQ ID NO: 70
  Synthetic Polynucleotide

SEQ ID NO: 783 - DNA, 1357 bp, Artificial Sequence; identical to SEQ ID NO: 173
  Synthetic Polynucleotide

SEQ ID NO: 784 - DNA, 1384 bp, Artificial Sequence; identical to SEQ ID NO: 75
  Synthetic Polynucleotide

SEQ ID NO: 785 - DNA, 1367 bp, Artificial Sequence; identical to SEQ ID NO: 61
  Synthetic Polynucleotide

SEQ ID NO: 786 - DNA, 1371 bp, Artificial Sequence; identical to SEQ ID NO: 74
  Synthetic Polynucleotide

SEQ ID NO: 787 - DNA, 1371 bp, Artificial Sequence; identical to SEQ ID NO: 56
  Synthetic Polynucleotide

SEQ ID NO: 788 - DNA, 1332 bp, Artificial Sequence; identical to SEQ ID NO: 170
  Synthetic Polynucleotide

SEQ ID NO: 789 - DNA, 1365 bp, Artificial Sequence; identical to SEQ ID NO: 125
  Synthetic Polynucleotide

SEQ ID NO: 790 - DNA, 1342 bp, Artificial Sequence
  Synthetic Polynucleotide
agagtttgatcctggctcaggatgaacgctggcggcgcgcctaacacatgcaagtcgaacggcacccctcctcggagggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatgggggaaccctgacgcagcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatcactccgtgccgcagccaacgcattaagcgtcccgcctggggagtacgaccgcaaggctaaaactcaaaggaattgacgggggcccgcacaagcagcggagcatgtggcttaattcgaagcaacgcgaagaaccttaccagggcttgacatgaccgtgaagccggggagacccggtggccgagaggagcggtcacaggtggtgcatggctgtcgtcagctcgtgtcgtgagatgtttggttaagtccagcaacgagcgcaacccccgccgcgtgttgccagcattgagttgggcactcgcgcgggactgccggcgtcaagccggaggaaggtggggacgacgtcaagtcatcatgcccctcatgccctgggctgcacacgtgctacaatggccggtacagcgggctgcgacgccgcgaggcggagcgaatcccacaaagccggccccagttcggaccgcaggctgcaacccgcctgcgcgaagccggagttgctagtaatcgaggatcagcatgccgcggtgaatacgttcccgggc

SEQ ID NO: 791 - DNA, 1365 bp, Artificial Sequence
  Synthetic Polynucleotide
agagtttgatcctggctcaggatgaacgctggcggcgcgcctaacacatgcaagtcgaacggcacccctcctcggagggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcagggatgagacaagacggtacctgcagaagaagccccggctaactacgtgccagcagccgcggtaatatgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaattcccggtgtagcggtggaatgcgcagatatcgggaggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggccaaaactcaaaggaattgacgggggcccgcacaagcagcggagcatgtggcttaattcgaagcaacgcgaagaaccttaccagggcttgacatgtgcgtgaagccggggagacccggtggccgagaggagcgcacacaggtggtgcatggctgtcgttagctcgtgtcgtgagatgttgggttaagtcccgcaacgagcgcaacccccgccgcatgttgccagcaggtcaggctgggcacccatgcgggaccgccggcgtcaagccggaggagggcggggacgacgtcaagtcatcatgccccttatgccctgggctgcacacgtgctacaatggccggtacagcgggatgcgatggcgcgagccggagcggatccctcaaagccggccccagttcggattgggggctgcaacccgcccccatgaagtcggagttgctagtaatcgcggatcagcatgccgcggtgaatgcgttcccgggccttgcacacaccgcccgtca

SEQ ID NO: 792 - DNA, 1364 bp, Artificial Sequence
  Synthetic Polynucleotide
agagtttgatcctggctcaggatgaacgctggcggcgcgcctaacacatgcaagtcggacggcacccaccctcgggtggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcggcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacggtggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgaccgcgaagccggggagacccggcggccgagaggagcggtcacaggtggtgcatggctgtcgtcagctcgtgtcgtgagatgtttggttaagtccagcaacgagcgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgaggtggagcaaatcccagaaaaccgatcgtagtccggattgcagtctgcaactcgactgcatgaagtcggaatcgctagtaatcgcggatcagcatgccgcggtgaatacgttcccgggtgttgtacacaccgcccgtca

SEQ ID NO: 793 - DNA, 1365 bp, Artificial Sequence
  Synthetic Polynucleotide
agagtttgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacaagcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatatcctgggctacacacgtaatacaatggcggtcaacagagggaagcaaagccgcgaggcagagcaaacccccaaaagccgtcccagttcggatcgtaggctgcaactcgcctgcgtgaagtcggaatcgctagtaatcgcggatcagcatgccgcggtgaatacgttcccgggccttgtacacaccgcccgtca

SEQ ID NO: 794 - DNA, 1330 bp, Artificial Sequence; identical to SEQ ID NO: 31
  Synthetic Polynucleotide

SEQ ID NO: 795 - DNA, 1469 bp, Artificial Sequence; identical to SEQ ID NO: 23
  Synthetic Polynucleotide

SEQ ID NO: 796 - DNA, 1409 bp, Artificial Sequence; identical to SEQ ID NO: 307
  Synthetic Polynucleotide

SEQ ID NO: 797 - DNA, 1385 bp, Artificial Sequence; identical to SEQ ID NO: 182
  Synthetic Polynucleotide

SEQ ID NO: 798 - DNA, 1416 bp, Artificial Sequence; identical to SEQ ID NO: 229
  Synthetic Polynucleotide

SEQ ID NO: 799 - DNA, 1345 bp, Artificial Sequence; identical to SEQ ID NO: 172
  Synthetic Polynucleotide

SEQ ID NO: 800 - DNA, 1351 bp, Artificial Sequence; identical to SEQ ID NO: 66
  Synthetic Polynucleotide

SEQ ID NO: 801 - DNA, 1366 bp, Artificial Sequence
  Synthetic Polynucleotide
agagtttgatcctggctcaggatgaacgctggcggcgcgcctaacacatgcaagtcgaacgacaccccacctcggtgggaagcgagtggcgaacggctgagtaacacgtggagaacccgccccctcctccgggatagcctcgggaaaccgtgggtaataccggatgacgcccggacgacgcatgtcgcccgggccaaagcccagacgggaggggatggctccgcggcccatcaggtagacggcggggtgaaggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgattcccccgtgccgcagccaatgcattaagcgttccgacaggggagtacggccgcaaggctaagactcaaaggaattgacgggggcgcgcacaagcaagcggagcatgtggcttaattaggaagcaacgagaagtacattaccagggcatgacatgttggtgaagcgggggagaccccgcgaccgagaggagccaacacaggtggtgcatggctgtcgtcagctcgtgtcgtgagatgtttggttaagtccagcaacgagcgcaacccccgctgcatgttgccatcaggtagagctgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctcaaagccggccccagttcggattgggggctgcaacccgcccccatgaagtcgagttgctagtaatcgcggatcagcatgccgcggtgaatgcgaacccgggccttgcactcaccgcccgtca

SEQ ID NO: 802 - DNA, 1365 bp, Artificial Sequence; identical to SEQ ID NO: 155
  Synthetic Polynucleotide

SEQ ID NO: 803 - DNA, 1330 bp, Artificial Sequence; identical to SEQ ID NO: 176
  Synthetic Polynucleotide

SEQ ID NO: 804 - DNA, 1373 bp, Artificial Sequence; identical to SEQ ID NO: 58
  Synthetic Polynucleotide

SEQ ID NO: 805 - DNA, 1357 bp, Artificial Sequence; identical to SEQ ID NO: 300
  Synthetic Polynucleotide

SEQ ID NO: 806 - DNA, 1478 bp, Artificial Sequence; identical to SEQ ID NO: 24
  Synthetic Polynucleotide

SEQ ID NO: 807 - DNA, 1391 bp, Artificial Sequence
  Synthetic Polynucleotide
agagtttgatcctggctcaggattaacgctggcggcatgcctaatacatgcaagtcgaacgagagtagcaatactctagtggcgaacgggtgagtaacacgtaggaaacctgcctcaaagtcgaggataactactggaaacggtagctaaaactggataggatatattaaggcatcttgatatatttaaaagtccttctgggaatgctttgagatggtcctgcggcgcattagctagttggtgaggtagtagcttaccaaggcgacgatgcgtagctgagctgagaggccaaacagccacactgggactgagacacggcccagactcctacgggaggcagcagtagggaattttcggcaatgggggaaaccctgaccgagcaatgccgcgtgaatgatgaaattcttcggaatgtaaaattctgttgtgagggaagaaaggtagtatcaggaaatgggtattacttgacggtaccttactagaaagccccggctaactatgtgccagcagccgcggtaatacatagggggcgagcgttatccggaattattgggcgtaaagagtacgtaggtggtttcctaagcacagggtttaaggctaaggctcaaccatagttcgccctgtgaactgggagacttgagtgcaggagaggaaagcggaattcctagtgtagcggtgaaatgcgtagatattaggaggaacaccagtggcgaaggcggctttctggactgtaactgacactgaggtacgaaagcgtggggagcaaacaggattagataccctggtagtccacgccgtaaacgatgagcactaggtgtcgggggccgcaaggttttggtgccgcagttaacgcattaagtgctccgcctggggagtacgctcgcaagttgaaactcaaaggaattgacgggggacccgcacaagcagcggagcatgtggtttaattcgaagcaacgcgaagaaccttaccagggcttgacatccctctgaccggactttaacaggtctttctcttcggagcagaggtgacaggtagtgcatggttgtcgtcagctcgtgtcgtgagatgttgggttaagtcccgcaacgagcgcaacccttgtcattagttgccatcattaagttgggcactctagtgagactgccggggacaactcggaggaaggtggggatgacgtcaaatcatcatgccccttatgttctgggctacacacgtgctacaatggccggtacagaaagcagcgaagtcgtgaggcggagcaaatctccaaaaccggtcccagttcggattgcaggctacaactcacctgcatgaagttggagttgctagtaatcgcagatcagaatgctgcggtgaatgcgttcccgggtctcgcacaaaccgcccgtca

SEQ ID NO: 808 - DNA, 1437 bp, Artificial Sequence
  Synthetic Polynucleotide
gatgaacgctggcggcgtgcctaacacatgcaagtcgagcgagaaacttatgacggatacttcggttgacagaataagcggaaagcggcggacgggtgagtaacgcgtaggcaacctgccctgtacagagagatagccattggaaacgatgattaatacctcataatgcctaatgtacacatgtacgaaaggccaaagatttatcggtatgggatgggcctgcgtctgattagctggttggtgaggtaacggctcaccaaggcaacgatcagtagccgacctgagagggtgatcggccacattggaactgagacacggtccaaactcctacgggaggcagcagtggggaatattgcacaatgggcgaaagcctgatgcagcaacgccgcgtgaaggatgaaggctttcgggtcgtaaacttcagttcttagggaagaaaaaaatgacggtacctaaggaggaagccccggctaactacgtgccagcagccgcggtaatacgtagggggcgagcgttatccggaattattgggcgtaaagagtgcgtaggtggttacctaagcgcagggtataaggcaatggcttaaccattgttggccttgcgaactgggctacttgagtgcaggagaggaaagcggaattcctagtgtagcggtgaaatgcgtagatattaggaggaacaccagtggcgaaggcggctttctggactgaaactgacactgaggcacgaaagcgtggggagcaaacaggattagataccctggtagtccacgccgtaaacgatgagcactaggtgtcggggtcgcaagacttcggtgccgcagttaacgcaataagtgctccgcctggggagtacgcacgcaagtgtaaaactcaaaggaattgacggggacccgcacaagcagcggagcatgtggtttaattcgaagcaacgcgaagaaccttaccaggacttgacatcctcctgacagatccttaatcggatccttctacggacaggagagacaggtggtgcatggttgtcgtcagctcgtgtcgtgagatgttgggttaagtcccgcaacgagcgcaacccttgccattagttaccatcattaagttggggactctaatgggactgccggggacaactcggaggaaggtggggatgacgtcaaatcatcatgccccttatgttctgggctacacacgtgctacaatggccggtacagaaggaagcgaacccgcgagggggagcgaaccccaaaagccggtcccagttcggactgcaggctgcaacccgcctgcacgaagttggagttgctagtaatcgcagatcagaatgctgcggtgaatgcgttcccgggtcttgtacacaccgcccgtcacaccatggaagttgggggtgcccaaagtcggttaaaaatagctgcctaaggcaaaaccaatgactggggtg

SEQ ID NO: 809 - DNA, 1385 bp, Artificial Sequence
  Synthetic Polynucleotide
agagtttgatcctggctcaggatgaacgctggcggcgtgcctaacacatgcaagtcgagcgagaagcttctgatggaatcttcggatgaaagaggaagtggaaagcggcggacgggtgagtaacgcgtaggcaacctgccccttgcagagggatagccactggaaacggtgattaaaacctcataacactttatcatcacatggagataaagccaaagatttatcggcaagggatgggcctgcgtctgattagctagttggtggggtaacggctcaccaaggcgacgatcagtagccgacctgagagggtgaacggccacattggaactgagacacggtccaaactcctacgggaggcagcagtggggaatattgcacaatgggcgaaagcctgatgcagcaacgccgcgtgaaggaagaaggtcttcggatcgtaaacttctgtcctaggggaagaagaactgacggtacccttggaggaagccccggctaactacgtgccagcagccgcggtaatacgtagggggcaagcgttatccggaattattgggcgtaaagagtgcgtaggtggttctttaagcgcagggtttaaggcaatggctcaaccattgttcgccctgcgaactggaggacttgagtgcaggagaggaaagcggaattcctagtgtagcggtgaaatgcgtagatattaggaggaacaccagtggcgaaggcggctttctggactgtaactgacactgaggcacgaaagcgtggggagcaaacaggattagataccctggtagtccacgccgtaaacgatgagcactaggtgtcggggtcgcaagacttcggtgccgtagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatccctctgacagaaccctaaccggttccttctacggacagaggagacaggtggtgcatggttgtcgtcagctcgtgtcgtgagatgttgggttaagtcccgcaacgagcgcaacccttgccaatagttgccatcattaagttgggcactctattgggactgccggggacaactcggaggaaggtggggatgacgtcaaatcatcatgccccttatgttctgggctacacacgtgctacaatggccggtacagaaagaagcgaagtcgtgaggcggagcaaatctcgaaaaccggtcccagttcggactgcaggctgcaactcgcctgcacgaagtcggagttgctagtaatcgtggatcagaatgccacggtgaatgcgttcccgggtcttgcacacaccgcccgtca

SEQ ID NO: 810 - DNA, 1476 bp, Artificial Sequence
  Synthetic Polynucleotide
agttcgattctggctcaggatgaacgctggcggcgtgcctaacacatgcaagtcgagcgagaaacgggaagcggagatttcgattgaagtttcccgcggaaagcggcggacgggtgagtaacgcgtaggcaacctgccctttgcagagggatagcctcgggaaaccgggattaaaacctcatgatgccgagagcccgcatgggcatttggtcaaagattcatcggcaaaggatgggcctgcgtctgattagttagttggtggggtaacggcctaccaaggcgacgatcagtagccgacctgagagggtgatcggccacattggaactgagacacggtccaaactcctacgggaggcagcagtggggaatcttgcacaatgggcgaaagcctgatgcagcaacgccgcgtgagcgaagaaggcctttgggtcgtaaagctctgtcctaagggaagaaggaagtgacggtaccttaggaggaagccccggctaactacgtgccagcagccgcggtaatacgtagggggcaagcgttatccggaattattgggcgtaaagagtacgtaggcggttctttaagcgcagggtataaggcgaaggcttaaccatcgttcgccctgtgaactgggggacttgagtatcggagaggaaagcggaattcctagtgtagcggtgaaatgcgtagatattaggaggaacaccagtggcgaaggcggctttctggacgaaaactgacgctgaggtacgaaagcgtggggagcaaacaggattagataccctggtagtccacgccgtaaacgatgagcactaggtgtcggggccgcaaggcttcggtgccggagttaacgcaataagtgctccgcctggggagtacgcacgcaagtgtgaaactcaaaggaattgacggggacccgcacaagcagcggagcatgtggtttaattcgaagcaacgcgaagaaccttaccagggcttgacatccctctgatgcatccttaatcggatggttctacggacagaggagacaggtggtgcatggttgtcgtcagctcgtgtcgtgagatgttgggttaagtcccgcaacgagcgcaacccttgtcgttagttgctaacagtaagatgagaactctaatgagactgccgtggataacacggaggaaggtggggatgacgtcaaatcatcatgccccttatgtcctgggctacacacgtgctacaatggtcggaacaaagagaagcgagactgtgaagtggagcaaaactcaaaaaccgatcccagttcggattgcaggctgcaactcgcctgcatgaagtcggagttgctagtaatcgcagatcagaatgctgcggtgaatgcgttcccgggtcttgtacacaccgcccgtcacaccatggaagttgggggcgcccgaagtcggctaggaaataggctgcctaaggtgaaaccaatgactggggtgaagtcgtaacaaggtagcc

SEQ ID NO: 811 - DNA, 1476 bp, Artificial Sequence; identical to SEQ ID NO: 3
  Synthetic Polynucleotide

SEQ ID NO: 812 - DNA, 1380 bp, Artificial Sequence; identical to SEQ ID NO: 62
  Synthetic Polynucleotide

SEQ ID NO: 813 - DNA, 1393 bp, Artificial Sequence
  Synthetic Polynucleotide
agagtttgatcctggctcaggatgaacgctggcggcgtgcttaacacatgcaagtcgagcgagaagctcatgattgattcttcggatgattgattgagtggaaagcggcggacgggtgagtaacgcgtaggcaacctgccccatgcagagggatagctactggaaacggtaattaatacctcataatacttttaagtcacatggctttgaggtcaaagatttatcggcatgggatgggcctgcgtctgattagcttgttggtgaggtaacggctcaccaaggcaacgatcagtagccgacctgagagggtaaacggccacattggaactgagacacggtccaaactcctacgggaggcagcagtggggaatattgcacaatgggggaaaccctgatgcagcaacgccgcgtgagcgaagaaggcctttgggtcgtaaagctctgtcctgagggaagaaacaaatgacggtacctcgggagaaagccccggctaactacgtgccagcagccgcggtaatacgtagggggcaaggcgttttccggaattattgggcgtaaagggtacgtaggcggtttaataagcgtggggtgaaaggcaatggcttaaccattgtaagccctgggaactgttagacttgagtgcaggagaggaaagcggaattcctagtgtagcggtgaaatgcgtagatattaggaggaacaccagtggcgaaggcggctttctggactgtaactgacgctgaggtacgaaagtgtggggagcaaacaggattagataccctggtagtccacaccgtaaacgatgagcactaggtgtcgggtaagcgattattcggtgccgcagttaacgcattaagtgctccgcctggggagtacgtacgcaagtatgaaactcaaaggaattgacggggacccgcacaagcagcggagcatgtggtttaattcgaagcaacgcgaagaaccttaccagggcttgacatccctctgacgtatcagataacgatgatattctcttcggagcagaggtgacaggtggtgcatggttgtcgtcagctcgtgtcgtgagatgttgggttaagtcccgcaacgagcgcaacccttgtcattagttgccggcattttggatgggcactctagtgagactgccggggataactcggaggaaggtggggatgacgtcaaatcatcatgccccttatgttctgggctacacacgtgctacaatggccggtacagagagaggcgaaatcgtgaggtggagcaaatctgataaaaccggtcccagttcggattgcaggctgaaactcgcctgcatgaagttggagttgctagtaatcgcggatcagaatgccgcggtgaatgcgttcccgggtcttgcactcaccgcccgtca

SEQ ID NO: 814 - DNA, 1424 bp, Artificial Sequence; identical to SEQ ID NO: 299
  Synthetic Polynucleotide

SEQ ID NO: 815 - DNA, 1386 bp, Artificial Sequence; identical to SEQ ID NO: 63
  Synthetic Polynucleotide

SEQ ID NO: 816 - DNA, 1312 bp, Artificial Sequence
  Synthetic Polynucleotide
  misc_feature (367)..(367): n is a, c, g, or t
  misc_feature (1267)..(1268): n is a, c, g, or t
  misc_feature (1270)..(1270): n is a, c, g, or t
  misc_feature (1301)..(1301): n is a, c, g, or t
gacgggtgagctaacgcgatgggcaacctgcctcacacagagggatagccattggaaacgatgattaaaacctcataatgcattttatccacatggatagaatgccaaagatttatcggtgtgagatgggcccgcgtctgattagttagttggtgaggtaacggctcaccaaggcagcgatcagtagccgacctgagagggtgatcggccacattggaactgagacacggtccaaactcatacgggaggcagcagtggggaatattgcacaatgggcgaaagcctgatgcagcaacgccgcgtgagcgatgaaggccttcgggtcgtaaagctctgtccttggggaagaaaaaaatgacggtacccnttggaggaagccccgggctaactacgtgcccagcagccgcggtaatacgtagggggcgagcgttatccggaattattgggcgtaaagagtgcgtaggtggttacctaagcgcagggtttaaggcaatggctcaaccattgtatgccttgcgaactgggctacttgagtgcaggagaggaaagcggaattcctagtgtagcggtgaaatgcgtagatattaggaggaacaccagtggcgaaggcggctttctggactgtaactgacactgaggcacgaaaggcgtggggagcaaacaggattagataccctggtagtccacgccgtaaacgatgagcactaggtgtcggggtcgcaagacttcggtgccgcagttaacgcattaagtgctccgcctggggagtacgcacgcaagtgtgaaactcaaaggaattgacggggacccgcacaagcagcggagcatgtggtttaattcgaagcaacgcgaaaaaccttaccaggacttgacatccttctgaccgcttcttaatcgaagctttccttcgggacggaagagacaggtggtgcatggttgtcgtcagctcgtgtcgtgagatgttgggttaagtcccgcaacgagcgcaacccttgtcattagttgccatcattaagttgggcactctagtgagactgccggggataactcggaggaaggtggggatgacgtcaaatcatcatgccccttatgttctgggctacacacgtgctacaatggtcggtacagaaagcagcaataccgtgaggtggagcaaatcttgaaaaccgatcccagttcggattgtaggctgcaactcgcctacatgaagttggagttgctagtaatcgcagatcagaatgctgcggtgaatgcgttcccgggtctnntnaaaaccgcccgtcacaccacggaagttgggngtgcccaaagt

SEQ ID NO: 817 - DNA, 1475 bp, Artificial Sequence
  Synthetic Polynucleotide
agaatttgatcatggctcaggatgaacgctggcggcgtgcctaacacatgcaagtcgagcgagaaatcttcgaatgaagcttcggtagattttggagatggaaagcggcggacgggtgagtaacgcgtaggcaacctaccctttgcagagggatagcctcgggaaaccgggattaaaacctcataacaccttttaaagacatctttgaaaggtcaaagatttatcggcaaaggatgggcctgcgtctgattagttagttggtggggtaacggcctaccaaggcaacgatcagtagccgacctgagagggtgatcggccacattggaactgagacacggtccaaactcctacgggaggcagcagtggggaatattgcacaatgggggaaaccctgatgcagcaacgccgcgtgaaggaagaaggcccttgggtcgtaaacttctgttctaagggaagataatgacggtaccttaggagcaagtcccggctaactacgtgccagcagccgcggtaatacgtagggggcgagcgttatccggaattattgggcgtaaagagtgcgtaggtggttacctaagcaaggggtttaaggctatagcttaactatagttcgccctttgaactgggctacttgagtgcaggagaggaaagcggaattcctagtgtagcggtgaaatgcgtagatattaggaggaacaccagtggcgaaggcggctttctggactgtaactgacactgaggcacgaaagcgtggggagcaaacaggattagataccctggtagtccacgccgtaaacgatgagcactaggtgtcggggtcgcaaggcttcggtgccgcagttaacgcaataagtgctccgcctggggagtacgtacgcaagtatgaaactcaaaggaattgacggggacccgcacaagcagcggagcatgtggtttaattcgaagcaacgcgaagaaccttaccagggcttgacatctccttgaccggtcggtaaagcgacctttcttcggacaaggatgacaggtggtgcatggttgtcgtcagctcgtgtcgtgagatgttgggttaagtcccgcgacgagcgcaacccttgtcattagttgccatcattaagttgggcactctagtgagactgccggggataactcggaggaaggtggggatgacgtcaaatcatcatgccccttatgttctgggctacacacgtgctacaatggtcggtacaaagagcagcgagaccgtgaggtggagcaaatctcaaaaaccgatcccagttcggattgcaggctgcaactcgcctgcatgaagtcggagttgctagtaatcgtggatcagaatgccacggtgaatgcgttcccgggtcttgtacacaccgcccgtcacaccatggaagttgggggcgcccgaagtcggctaagtaataggctgcctaaggcgaaatcaatgactggggtgaagtcgtaacaaggtaacc

SEQ ID NO: 818 - DNA, 1384 bp, Artificial Sequence
  Synthetic Polynucleotide
agagtttgatcctggctcaggatgaacgctggcggcgtgcctaacacatgcaagtcgagcgagaagctcatgacggacgcttcggttgaagtcacgagtggaaagcggcggacgggtgagtaacgcgtaggcaacctgccctttgcagagggatagcctcgggaaaccgggattaaaacctcataatgccgcagtgagacatctcacggcggtcaaagatttatcggcaaaggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggatgaaggcctttgggtcgtaaacttctgttctaagggaagatagtgacggtaccttaggagcaagtcccggctaactacgtgccagcagccgcggtaatacgtagggggcaagcgttatccggaattattgggcgtaaagagtacgtaggtggttttctaagcacgaggtttaaggcaatggcttaaccattgttcgccttgtgaactggaagacttgagtgcaggagaggaaagcggaattcctagtgtagcggtgaaatgcgtagatattaggaggaacaccagtggcgaaggcggctttctggactgtaactgacactgaggtacgaaaagcgtggggagcaaacaggattagataccctggtagtccacgccgtaaacgatgagcactaggtgtcggggtcgcaagacttcggtgccgcagttaacgcattaagtgctccgcctggggagtacgttcgcaagaatgaaactcaaaggaattgacggggacccgcacaagcagcggagcatgtggtttaattcgaagcaacgcgaagaaccttaccagggcttgacatccctctgacagatccttaaacggattcttcttcggacagaggagacaggtggtgcatggttgtcgtcagctcgtgtcgtgagatgttgggttaagtcccgcaacgagcgcaacccttgtcattagttgccagcagtaagatgggcactctagtgagactgccggggataactcggaggaaggtggggatgacgtcaaatcatcatgccccttatgttctgggctacacacgtgctacaatggccggtacagagagaagccagaccgcgaggtggagcaaaactcaaaagccggtcctagttcggattgcaggctgcaactcgcctgcatgaagtcggagttgctagtaatcgcgaatcagaatgtcgcggtgaatacgttcccgggtcttgtactcaccgcccgtca

SEQ ID NO: 819 - DNA, 1350 bp, Artificial Sequence
  Synthetic Polynucleotide
gatgaacgctggcggcgtgcctaatacatgcaagtcgagcgagaagtcacattactaattcttcggaagaagtaaagtgatggaaagcggcggacgggtgagtaacgcgtaggcaacctgcctctcacagggggatagccatcggaaacggtgattaataccccataaagtcaaaataacacatgttaagctgaccaaagatttatcggtgagagatgggcctgcgtctgattaactagttggtgaggtaacggctcaccaaggtgacgatcagtagccgacctgagagggtgaacggccacattggaactgagacacggtccaaacttctacggaaggcagcagtagggaatcttgcacaatgggcgaaagcctgatgcagcaacgccgcgtgaaggaagaaggccttagggtcgtaaacttctgttcttggggaagaaaaaaatgacggtacccaaggaggaagccccggctaactacgtgccagcagccgcggtaatacgtagggggcaagcgttatccggaattattgggcgtaaagcgtgcgtaggtggtaatttaagcgcaaggtttaaactaacggctcaaccgttaattgccatgcgaactgggttacttgagtgctggaggggaaagcggaattcctagtgtagcggtgaaatgcgtagatattaggaggaacaccggcggcgaaggcggctttctggacagcaactgacactgaggcacgaaagtgtgggtagcaaacaggattagataccctggtagtccacaccgtaaacgatgagcactaggtgtcggggtcgatagacttcggtgccgcagttaacgcactaagtgctccgcctggggagtacggtcgcaagactaaaactcaaaggaattgacggggacccgcacaagcagcggagcatgtggtttaattcgaagcaacgcgaagaaccttaccaggacttgacgtccctctgacaggaacttaatcgtttttttctacggacagaggagacaggtggtgcatggttgtcgtcagctcgtgtcgtgagatgttgggttaagtcccgcaacgagcgcaacccttgttgtcagttactaacattaagttgaggactctgacgagactgccgaggttaactcggaggaaggtggggatgacgtcaaatcatcatgccccttatgttctgggctacacacgtgctacaatggtcggtacagagagaagcaaagcagcgatgcggagcaaaacataaaaaccgatctcagttcggactgctggctgaaactcgcctgcacgaagatggagttgctagtaatcgcagatcagaatgctgcggtgaatgcgttcccgggtct

SEQ ID NO: 820 - DNA, 1386 bp, Artificial Sequence; identical to SEQ ID NO: 141
  Synthetic Polynucleotide

SEQ ID NO: 821 - DNA, 1438 bp, Artificial Sequence; identical to SEQ ID NO: 21
  Synthetic Polynucleotide

SEQ ID NO: 822 - DNA, 1479 bp, Artificial Sequence; identical to SEQ ID NO: 98
  Synthetic Polynucleotide

SEQ ID NO: 823 - DNA, 1521 bp, Artificial Sequence
  Synthetic Polynucleotide
aactaattgagagtttgatcctggctcaggatgaacgctggcggcgtgcctaacacatgcaagtcgagcgagaagtaaagaaatgaagcttcggtagattttcattatggaaagcggcggacgggtgagtaacgcgtaggcaacctgccctgtacagggggatagccacccgaaaaggtgattaataccccatgatgcaagagatacacatgtatcacttgtcaaagatttatcggtatgggatgggcctgcgtctgattagctagttggtagggtaacggcttaccaaggcaacgatcagtagccgacctgagagggtgatcggccacattggaactgagacacggtccaaactcctacgggaggcagcagtggggaatattgcacaatgggggaaaccctgatgcagcaacgccgcgtgaaggaagaaggccttcgggttgtaaacttctgtcctaggggaagaaacaaatgacattacccttggaggaagccccggctaactacgtgccagcagccgcggtaatacgtagggggcgagcgttatccggaattattgggcgtaaagagtgcgtaggtggcatcttaagcgcagggtttaaggcaatggctcaaccattgttcgccttgcgaactggggtgcttgagtgcaggaggggaaagtggaattcctagtgtagcggtgaaatgcgtagatattaggaggaacaccagtggcgaaggcgactttctggactgttactgacactgaggcacgaaagcgtggggagcaaacaggattagataccctggtagtccacgccgtaaacgatgagcactaggtgtcggggtcgcaagacttcggtgccgcagttaacgcattaagtgctccgcctggggagtacgcacgcaagtgtaaaactcaaaggaattgacggggacccgcacaagcagcggagcatgtggtttaattcgaagcaacgcgaagaaccttaccaggacttgacatcctcttgacagatccttaatcggattcttcttcggacaagagagacaggtggtgcatggttgtcgtcagctcgtgtcgtgagatgttgggttaagtcccgcaacgagcgcaacccttgccattagttgccatcatttagttgggcactctagtgggactgccggggaaaactcggaggaaggtggggatgacgtcaaatcatcatgccccttatgttctgggctacacacgtgctacaatggccggtacaacaggcagcgaacccgtgagggggagcgaatcccaaaagccggtcccagttcggactgtaggctgcaactcgcctacacgaagttggagttgctagtaatcgcggatcagaatgccgcggtgaatgcgttcccgggtcttgtacacaccgcccgtcacaccatggaagttgggggtgcccgaagtcggttatttaatctatcgcctaaggcaaaaccaatgactggggtgaagtcgtaacaaggtagccgtatcggaaggtgcggctggatcacctcctttct

SEQ ID NO: 824 - DNA, 1477 bp, Artificial Sequence; identical to SEQ ID NO: 100
  Synthetic Polynucleotide

SEQ ID NO: 825 - DNA, 1376 bp, Artificial Sequence; identical to SEQ ID NO: 179
  Synthetic Polynucleotide

SEQ ID NO: 826 - DNA, 1380 bp, Artificial Sequence
  Synthetic Polynucleotide
agagtttgatcctggctcaggacgaacgctggcggcgtgcttaacacatgcaagtcgagcggggattacaggagagcttgctcaaatgtaattctagcggcggacgggtgagtaacgcgtgagcaatctgtcccaggcagggggataacacttggaaacaggtgctaataccgcataagaccacgaaatcgcatggttttgaggtaaaagagatatcggtttggggtgagctcgcgtcccattagctagttggtgaggtaacggcccaccaaggcgacgatgggtagccgacctgagagggtgatcggccacattggaactgagacacggtccagactcctacgggaggcagcagtggggaatattgggcaatgggcgcaagcctgacccagcaacgccgcgtgaaggaagaaggttttcggattgtaaacttctgtccttggtgacgaaggaagtgacggtagccaaggaggaagccccggctaactacgtgccagcagccgcggtaatacgtagggggcaagcgttatccggaattattgggcgtaaagagtgcgtaggtggttacctaagcagggggtgaaaggcaatggctcaaccattgttagccccctgaactgggctacttgagtgcaggagaggaaagcggaattcctagtgtagcggtgaaatgcgtagatattaggaggaacaccagtggcgaaggcggctttctggactgtaactgacactgaggcacgaaagtgtggggagcaaacaggattagataccctggtagtccacaccgtaaacgatgagcactaggtgtcggggtcgcaaggcttcggtgccgcagttaacgcattaagtgctccgcctggggagtacgtacgcaagtatgaaactcaaaggaattgacggggacccgcacaagcagcggagcatgtggtttaattcgaagcaacgcgaagaaccttaccaggacttgacatcccgatgaccggttcttaaccgaaccttctcttcggagcatcggtgacaggtggtgcatggttgtcgtcagctcgtgtcgtgagatgttgggttaagtcccgcaacgagcgcaacccttgccattagttgccatcattaagttgggcactctagtgggactgccggggataactcggaggaaggtggggatgacgtcaaatcatcatgccccttatgttctgggctacacacgtgctacaatggtcggtacaaagagcagcaataccgtgaggtggagcaaatctcaaaagccgatcccagttcggattgtaggctgcaactcgcctacatgaagttggagttgctagtaatcgcggatcagaatgccgcggtgaatgcgttcccgggtcttgcacacaccgcccgtca

SEQ ID NO: 827 - DNA, 1366 bp, Artificial Sequence; identical to SEQ ID NO: 139
  Synthetic Polynucleotide

SEQ ID NO: 828 - DNA, 1387 bp, Artificial Sequence
  Synthetic Polynucleotide
agagtttgatcctggctcaggatgaacgttggcggcgtgtttaacacatgcaagtcgagcgagaagctttcgagtagattcttcggatgatacatgagagtggaaagcggcggacgggtgagtaacgcgtaggcaacctgccccttgcagagggatagcctcgggaaaccgggattaaaacctcataatgccatctgtcgacatcttcggatggccaaagatttatcggcaagggatgggcctgcgtctgattagttagttggtggggtaacggcctaccaaggcagcgatcagtagccgacctgagagggtgatcggccacattggaactgagacacggtccaaactcctacgggaggcagcagtggagaatcttgcacaatgggggaaaccctgatgcagcaacgccgcgtgaaggaagaaggcccttgggtcgtaaacttcttttctaagggaagatagtgacggtaccttaggaataagtcccggctaactacgtgccagcagccgcggtaatacgtagggggcgaacgttatccggaattattgggcgtaaagagtacgtaggtggtttcctaagcatggggtttaaggcaatggcttaactattgttcgccccatgaactgggttacttgagtgcaggagaggaaagcggaattcctagtgtagcggtgaaatgcgtagatattaggaggaacaccagtggcgaaggcggctttctggactgtaactgacactgaggtacgaaagtgtggggagcaaacaggattagataccctggtagtccacaccgtaaacgatgagcactaggtgtcggcttcgcaagaagtcggtgccgcagttaacgcattaagtgctccgcctggggagtacgtacgcaagtatgaaactcaaaggaattgacggggacccgcacaagcagcggagcatgtggtttaattcgaagcaacgcgaagaaccttaccaggacttgacatccctctgaccgctctgataacgatgagctttcttcggacagaggtgacaggtggtgcatggttgtcgtcagctcgtgtcgtgagatgttgggttaagtcccgcaacgagcgcaacccttgtcattagttgccatcattcagttgggcactctagtgagactgccggggataactcggaggaaggtggggatgacgtcaaatcatcatgccccttatgttctgggctacacacgtgctacaatggtcggtacaaagagcagcaagaccgtgaggtggggcaaatctcaaaagccgatcccagttcggattgcaggctgcaactcgcctgcatgaagtcggagttgctagtaatcgtggatcagaatgccacggtgaatgcgttcccgggtcttgtacacaccgcccgtca

SEQ ID NO: 829 - DNA, 1386 bp, Artificial Sequence; identical to SEQ ID NO: 69
  Synthetic Polynucleotide

SEQ ID NO: 830 - DNA, 1478 bp, Artificial Sequence
  Synthetic Polynucleotide
agtttgatcatggctcaggatgaacgctggcggcgtgcctaatacatgcaagtcgagcgagatgttagcgcatgaaccttcgggggattatgctaacggaaagcggcggacgggtgagtaacgcgtaggcaacctgcccctgacagagggatagccattggaaacgatgattaaaacctcatgacaccgatgaagcacatgcttcatcggtcaaagatttatcggtcagggatgggcctgcgtctgattaactagttggtgaggtaacggctcaccaaggtgacgatcagtagccgacctgagagggtgatcggccacattggaactgagacacggtccaaacttctacggaaggcagcagtagggaatcttgcacaatgggcgaaagcctgatgcagcaacgccgcgtgaaggatgaaggccttcgggttgtaaacttctgttctaagggaagaaacaaatgacggtaccttaggagcaagccccggctaactacgtgccagcagccgcggtaatacgtagggggcaagcgttatccggaattattgggcgtaaagagtgcgtaggtggttacctaagcgcaaggtttaatttagaggctcaacctctacttgccttgcgaactgggctacttgagtgcaggaggggaaagcggaattcctagtgtagcggtgaaatgcgtagatattaggaggaacaccagcggcgaaggcggctttctggactgtaactgacactgaggcacgaaagcgtgggtagcaaacaggattagataccctggtagtccacgccgtaaacgatgagcactaggtgttgggcccgttaggctcagtgccgcagttaacgcaataagtgctccgcctggggagtacgctcgcaagagtaaaactcaaaggaattgacggggacccgcacaagcagcggagcatgtggtttaattcgaagcaacgcgaagaaccttaccagggcttgacatcctgctgacaggaccttaaccggtcccttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgggatgcaatactgtgaagtggagcaaatcaccaaaaccgatcccagttcggattgtaggctgcaactcgcctacatgaagttggagttgctagtaatcgcagatcagaatgctgcggtgaatgcgttcccgggtcttgtacacaccgcccgtcacaccatgggaagttgggggtgcccaaagtcggttaattaatctatcgcctaaggcaaaaccaatgactggggtgaagtcgtaacaaggtaaccgt

SEQ ID NO: 831 - DNA, 1442 bp, Artificial Sequence; identical to SEQ ID NO: 255
  Synthetic Polynucleotide

SEQ ID NO: 832 - DNA, 1359 bp, Artificial Sequence; identical to SEQ ID NO: 43
  Synthetic Polynucleotide

SEQ ID NO: 833 - DNA, 1477 bp, Artificial Sequence; identical to SEQ ID NO: 225
  Synthetic Polynucleotide

SEQ ID NO: 834 - DNA, 1517 bp, Artificial Sequence; identical to SEQ ID NO: 206
  Synthetic Polynucleotide

SEQ ID NO: 835 - DNA, 1477 bp, Artificial Sequence; identical to SEQ ID NO: 106
  Synthetic Polynucleotide

SEQ ID NO: 836 - DNA, 1379 bp, Artificial Sequence
  Synthetic Polynucleotide
agagtttgatcctggctcaggatgaacgctggcggcgcacttaagacatgcaagtcgaacggaaatttatcttaagtttactttagataaattttagtggcggacgggtgagtaatacgtaggcaacctgcctcaaagagagggataactgggagaaatttcagctaatacctcataagaccacactgcggcatcgcagaggggtcaaaggagtaatccgctttgagatggacccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttggggacgataatgacggtacccaaggaggaagccacggctaactacgtgccagcagccgcggtaatacgtaggtggcgagcgttgtccggatttactgggcgtaaagggtgcgtaggcggtctttcaagtcaggagttaaaggctacggctcaaccgtagtaagctcctgatactgtctgacttgagtgcaggagaggaaagcggaattcccagtgtagcggtgaaatgcgtagatattgggaggaacaccagtagcgaaggcggctttctggactgtaactgacgttgaggctcgaaagcgtggggagcaaacaggattagataccctggtagtccacgctgtaaacgatgaatactaggtgtgggaggactgaccccttccgtgccgcagttaacacaataagtattccacctggggagtacgaccgcaaggttgaaactcaaaggaattgacgggggcccgcacaagcagtggattatgtggtttaattcgacgcaacgcgaagaaccttaccaggatttgacatcctactaacgaagcagagatgcattaggtgcccttcggggaaagtagagacaggtggtgcatggttgtcgtcagctcgtgtcgtgagatgttgggttaagtcccgcaacgagcgcaacccctattgttagttgctacgaaagagcactctagcaagactgccgttgacaaaacggaggaaggcggggacgacgtcaaatcatcatgccccttatgtcctgggctacacacgtaatacaatggcggtcaacaaagggaagcaataccgcgaggtggagcaaatccccaaaagctgtctcagttcggattgcaggctgcaactcgcctgcatgaagctggaattgctagtaatcgtggatcagcatgccacggtgaatacgttcccgggccttgtactcaccgcccgtca

SEQ ID NO: 837 - DNA, 1436 bp, Artificial Sequence; identical to SEQ ID NO: 209
  Synthetic Polynucleotide

SEQ ID NO: 838 - DNA, 1370 bp, Artificial Sequence; identical to SEQ ID NO: 147
  Synthetic Polynucleotide

SEQ ID NO: 839 - DNA, 1386 bp, Artificial Sequence
  Synthetic Polynucleotide
agagtttgatcctggctcaggatgaacgctggcggcgtgcctaacacatgcaagtcgagcgagaagcttctgatagattcttcggatgaaagaggaagcggaaagcggcggacgggtgagtaacgcgtaggcaacctgcctctcacagaaggatagccattggaaacgatgattaaaacctcataacgccggagagagacatctccctccggccaaagatttatcggtgagagatgggcctgcgtctgattagctagttggcggggtaacggcccaccaaggcgacgatcagtagccgacctgagagggtgatcggccacattggaactgagacacggtccaaactcctacgggaggcagcagtggggaatattgcacaatgggcgaaagcctgatgcagcaacgccgcgtgaaggaagaaggccttcgggtcgtaaacttctgtccttggggaagaagaactgacggtacccatggaggaagccccggctaactacgtgccagcagccgcggtaatacgtagggggcaagcgttatccggaattattgggcgtaaagcgtgcgtaggtggttctttaagcgcagggtttaaggcaatggcccaaccattgttcgccctgcgaactggaggacttgagtgcaggagaggaaagcggaattcctagtgtagcggtgaaatgcgtagatattaggaggaacaccagtggcgaaggcggctttctggactgtaactgacactgaggcacgaaagcgtggggagcaaacaggattagataccctggtagtccacgccgtaaacgatgagcactaggtgtcgggtccgcgaggaataggtgccgcagttaaagcattaagtgcccccgcctggggagtacgcacgcaagtgtgaaactcaaaggaatagacgggggcccgcacaagcagcggagcatgtggtttaatttgaagcaacgcgaagaaccttaccaggacttgacatccctctgacagatccttaaccggatccttcttcggacagaggagacaggtggtgcatggttgtcgtcagctcgtgtcgtgagatgttgggttaagtcccgcaacgagcgcaacccttgccattagttgccatcattcagttgggcactctagtgggactgccggggacaactcggaggaaggtggggatgacgtcaaatcatcatgccccttatgttttgggctacacacgtgctacaatggccggtacagaaagcagcaaagccgcgaggcggagcgaatctcgaaaaccggtcccagttcggactgcaggctgcaacccgcctgcacgaagccggagttgctagtaatcgcggatcagaatgccgcggtgaatgcgttcccgggtcttgcacacaccgcccgtca

SEQ ID NO: 840 - DNA, 1434 bp, Artificial Sequence; identical to SEQ ID NO: 250
  Synthetic Polynucleotide

SEQ ID NO: 841 - DNA, 1364 bp, Artificial Sequence; identical to SEQ ID NO: 47
  Synthetic Polynucleotide

SEQ ID NO: 842 - DNA, 1506 bp, Artificial Sequence
  Synthetic Polynucleotide
gagtttgatcctggctcaggatgaacgctggcgacgtgcctaacacatgcaagtcgagcgagaaacttttaaatgaaacttcggtagattttagaagtggaaagcggcggacgggtgagtaacgcgtaggcaacctgccctttgcagagggatagcctcgggaaaccgggattaaaacctcataatgcctttgggagacatcttttaaaggccaaagatttatcggcaaaggatgggcctgcgtctgattagttagttggtggggtaacggcctaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggaagaaggcctttgggtcgtaaacttctgttctaagggaagaaaaggactgtaccttaggagcaagtcccggctaactacgtgccagcagccgcggtaatacgtagggggcaagcgctatccggaattattgggcgtaaagagtacgtaggtggctacctaagcacgaggtataaggctatggcttaaccatagttcgccttgtgaactgggctgcttgagtgcaggagaggaaagcsgaattcctagtgtagcggtgaaatgcgtagatattaggaggaacaccagtggcgaaggcggctttctggactgtaactgacactgaggtacgaaagcgtggggagcaaacaggattagataccctggtagtccacgccgtaaacgatgagcactaggtgtcggggtcgcaagacttcggtgccgcagttaacgcaataagtgctccgcctggggggtacgttcgcaagaatgaaactcaaaggaattgacggggacccgcacaagcagcggagcatgtggtttaattcgaagcaacgcgaagaaccttaccagggcttgacatcccactgaccggttcttaaacgaacctttcttcggacagtggagacaggtggtgcatggttgtcgtcagcccgtgtcgtgagatgttgggttaagtcccgcaacgagcgcaacccttgtcattagttgccatcagattagctgggcactctagtgagactgccgtggataacacggaggaaggtggggatgacgtcaaatcatcatgccccttatgttctgggctacacacgtgctacaatggtcggtacagagagaagcgaggccgtgaggcggagcaaaactagaaaaccgatcccagttcggattgcaggctgcagctcgcctgcatgaagtcggagttgctagtaatcgcgaatcagaatgtcgcggtgaatgcgttcccgggtcttgtacacaccgcccgtcacaccatggaagttgggggcgcccgaagttggtcgagaaatagattacctaaggcgaaatcaatgactggggtgaagtcgtaacaaggtagccgtatcggaaggtgcggctggatcacctcctt

SEQ ID NO: 843 - DNA, 1488 bp, Artificial Sequence
  Synthetic Polynucleotide
ctgcagagaagagtttgatcctggctcaggatgaacgctggcggcgtgcctaatacatgcaagtcgagcgagaagcttggaaatgacgcttcggttgaatttccaagcggacagcggcggacgggtgagtaacgcgtaggcaacctgcccctgtacagagggatagccattggaaacgatgattaaaacctcatgacaccgtagtagcacatgctacatcggtcaaagatttatcggtcagggatgggcctccgtctgattaactggttggtgaggtaacggctcaccaaggtgacgatcagtagccgacctgagagggtgatcggccacattggaactgagacacggtccaaacttctacggaaggcagcagtagggaatcttgcacaatgggcgtaagcctgatgcagcaacgccgcgtgaaggatgaaggcttcgggttgtaaacttctgttctaagggaagaaagaaatgacggtaccttaggagcaagccccggctaactacgtgccagcagccgcggtaatacgtagggggcaagcgttatccggaattattgggcgtaaagagtgcgtaggtggttacctaagcgcaaggtttaaattagaggctcaacctctacatgccttgcgaactgggctacttgagtgcaggaggggaaagcggaattcctagtgtagcggtgaaatgcgtagatattaggaggaacaccggcggcgaaggcggctttctggactgtaactgacactgaggcacgaaagcgtgggtagcaaacaggattagataccctggtagtccacgccgtaaacgatgagcactaggtgttgggtccgttaggactcagtgccgcagttaacgcaataagtgtccgcctgggagtacgctcgcaagagtaaactcaaggaattgacgggcacccgcacaagcaggggagcttgtggtttaattcgaagcaacgcgaagaaccttaccagggcttgacatcctgctgacagaaccttaatcggttttttcttcggacagcagagacaggtggtgcatggttgtcgtcagctcgtgtcgtgagatgttgggttaagtcccgcaacgagcgcaacccttgtcgctagttactaacattcagttgaggactctagcgagactgccgaggtcaactcggaggaaggtggggatgacgtcaaatcatcatgccccttatgttctgggctacacacgtgctacaatggtcggtacaatgagatgcaatactgcgaagtggagcgaaacaccaaaaccgatcccagttcggattgtaggctgcaactcgcctacatgaagtcggagttgctagtaatcgcagatcagaatgctgcggtgaatgcgttcccgggtcttgtacacaccgcccgtcacaccatggaagttgggggtgcccaaagtcggttaattaatctatcgcctaaggcaaaaccaatgactggggtgaagtcgtaacaaggtacccgtagg

SEQ ID NO: 844 - DNA, 1481 bp, Artificial Sequence; identical to SEQ ID NO: 266
  Synthetic Polynucleotide

SEQ ID NO: 845 - DNA, 1410 bp, Artificial Sequence; identical to SEQ ID NO: 152
  Synthetic Polynucleotide

SEQ ID NO: 846 - DNA, 1478 bp, Artificial Sequence; identical to SEQ ID NO: 103
  Synthetic Polynucleotide

SEQ ID NO: 847 - DNA, 1474 bp, Artificial Sequence; identical to SEQ ID NO: 199
  Synthetic Polynucleotide

SEQ ID NO: 848 - DNA, 1475 bp, Artificial Sequence
  Synthetic Polynucleotide
gagtttgatcctggctcaggatgaacgctggcggcgtgcctaacacatgcaagtcgagcgagaagctgtttaatgaaacttcggtagatttaaaaagtggaaagcggcggacgggtgagtaacgcgtgggcaacctgccttacacagagggatagccattggaaacgatgattaaaacctcataacgcttttttagcacatgctgaggaagccaaagatttatcggtgtaagatgggcccgcgtctgattagttagttggtgaggtaacggctcaccaagacagcgatcagtagccgacctgagagggtgatcggccacattggaactgagacacggtccaaactcctacgggaggcagcagtggggaatattgcacaatgggcgaaagcctgatgcagcaacgccgcgtgaaggaagaaggccttcgggtcgtaaacttctgtccaaaaggaagaaaaaaatgacggtacttttggaggaagccccggctaactacgtgccagcagccgcggtaatacgtagggggcaagcgttatccggaattattgggcgtaaagagtgcgtaggtggttacctaagcgcagggtttaaggcaatggctcaaccattgttcgccttgcgaactgggctacttgagtgcaggagaggaaagcggaattcctagtgtagcggtgaaatgcgtagatattaggaggaacaccggtggcgaaggcggctttctggactgtaactgacactgaggcacgaaagcgtggggagcaaacaggattagataccctggtagtccacgccgtaaacgatgagcactaggtgtcggggccaaaaggcttcggtgccgcagttaacgcattaagtgctccgcctggggagtacgcacgcaagtgtaaaactcaaaggaattgacggggacccgcacaagcagcggagcatgtggtttaattcgaagcaacgcgaagaaccttaccaggacttgacatcctactgacggttccttaaccgggaccttcttcggacagtagagacaggtggtgcatggttgtcgtcagctcgtgtcgtgagatgttgggttaagtcccgcaacgagcgcaacccttgtcattagttgccatcattaagttgggcactctaatgagactgccggggacaactcggaggaaggtggggatgacgtcaaatcatcatgccccttatgttctgggctacacacgtgctacaatggtcggtacagagagcagcgaaatcgtgaggtggagcaaatcttcaaaaccgatcccagttcggactgcaggctgaaactcgcctgcacgaagtcggagttgctagtaatcgcagatcagaatgctgcggtgaatgcgttcccgggtcttgtacacaccgcccgtcacaccatggaagttgggggtgcccaaagttggacagtaaatagtttacctaaggcaaacccaatgactggggtgaagtcgtaacaaggtag

SEQ ID NO: 849 - DNA, 1428 bp, Artificial Sequence; identical to SEQ ID NO: 253
  Synthetic Polynucleotide

SEQ ID NO: 850 - DNA, 1386 bp, Artificial Sequence; identical to SEQ ID NO: 117
  Synthetic Polynucleotide

SEQ ID NO: 851 - DNA, 1481 bp, Artificial Sequence; identical to SEQ ID NO: 2
  Synthetic Polynucleotide

SEQ ID NO: 852 - DNA, 1380 bp, Artificial Sequence; identical to SEQ ID NO: 213
  Synthetic Polynucleotide

SEQ ID NO: 853 - DNA, 1401 bp, Artificial Sequence; identical to SEQ ID NO: 72
  Synthetic Polynucleotide

SEQ ID NO: 854 - DNA, 1502 bp, Artificial Sequence
  Synthetic Polynucleotide
tagagtttgatcctggctcaggatgaacgctagcgacaggcttaacacatgcaagtcgaggggcagcgggggtgatggcttgccatcgcctgccggcgaccggcgcacgggtgagtaacacgtatgcaacctgcccgccacagggggataagcggaagaaattccgtctaataccgcgtgacgcggcaccggggcatcccggtgccgccaaagggattaccggtggcggatgggcatgcggcgcattagctagtcggcggggtaacggcccaccgaggcgacgatgcgtaggggttctgagaggaaggtcccccacactggtactgagacacggaccagactcctacgggaggcagcagtgaggaatattggtcaatgggcgcgagcctgaaccagccaagtcgcgtgagggatgacggtcctacggattgtaaacctcttttgccggggagcaagcgtgcgttcgtgaacgcgcgtcgagagtacccggagaaaaagcatcggctaactccgtgccagcagccgcggtaatacggaggatgcgagcgttatccggatttattgggtttaaagggtgcgcaggcggaagatcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatgctggttgtccgggtcgaatgagatctgggcggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacgacacaggaatacttttgaaaggaggtagctctacggagtctgtgtcgaggtgctgcatggttgtcgtcagctcgtgccgtgaggtgtcggcttaagtgccataacgagcgcaacccccatcgccagttaccagcaagtcaagttggggactctggcgagactgccggcgcaagctgtgaggaaggcggggatgacgtcaaatcagcacggcccttacgtccggggcgacacacgtgttacaatggcaggtacagagagaagcaatgcggcgacgcaaagcggaacttgaaagcctgtctcagttcggattggagtctgcaactcgactccatgaagctggattcgctagtaatcgcgcatcagccatggcgcggtgaatacgttcccgggccttgtacacaccgcccgtcaagccatggaagccgggagtgcctgaagtgtgcaaccgcaaggagcgccctaagataaaactggtgactggggctaagtcgtaacaaggtaaccgta

SEQ ID NO: 855 - DNA, 1399 bp, Artificial Sequence
  Synthetic Polynucleotide
agagtttgatcctggctcaggatgaacgctagcgacaggcttaacacatgcaagtcgaggggcagcgggtagatgagcttgctcatttatgccggcgaccggcgcacgggtgagtaacacgtatgcaacctgcccgtctcagggggataatcgtcggaaacggcgtctaataccccgtatgaagctggacggcatcgtctggttttgaaagaatatcggagacggatgggcatgcggcgcattagctggttggcggggtaacggcccaccaaggcgacgatgcgtaggggttctgagaggaaggtcccccacactggtactgagacacggtccaaactcctacgggaggcagcagtgaggaatattggtcaatggccggaaggctgaaccagccaagtcgcgtgagggaataaggccctacgggtcgtaaacctcttttgccagggagcaatgccgtccacgtgtggacggaaggagagtacctggagaaaaagcatcggctaactccgtgccagcagccgcggtaatacggaggatgcgagcgttatccggatttattgggtttaaagggtgcgtaggcggcctgccaagtcagcggtaaaattgcggggctcaaccccgtacagccgttgaaactgccgggctcgagtgggcgagaagtatgcggaatgcgtggtgtagcggtgaaatgcatagatatcacgcagaactccgattgcgaaggcagcataccggcgccctactgacgctgaggcacgaaagcgtgggtatcgaacaggattagataccctggtagtccacgcagtaaacgatgaatgctaactgtccggtgcgagtgagcactgggcggtacagcgaaagcgttaagcatccacctggggagtacgccggcaacggtgaaactcaaaggaattgacgggggcccgcacaagcggaggaacatgtggtttaattcgatgatacgcgaggaaccttacccgggctcaaacgcaggatgacgggtcccgaaaggggcctttcttcggacattctgcgaggtgctgcatggttgtcgtcagctcgtgccgtgaggtgtcggcttaagtgccataacgagcgcaacccctgtccacagttgccagcaggtaaagctggggactctgtggagactgccggcgcaagctgcgaggaaggcggggatgacgtcaaatcagcacggcccttacgtccggggcgacacacgtgttacaatggcaggtacagcgggatgccacggggcgacccggcgctgaacccgaaaacctgtctcagttcggattggagtctgcaacccgactccatgaagctggattcgctagtaatcgcgcatcagccacggcgcggtgaatacgttcccgggccttgcacacaccgcccgtca

SEQ ID NO: 856 - DNA, 1398 bp, Artificial Sequence
  Synthetic Polynucleotide
agagtttgatcctggctcaggatgaacgctagcggcaggcttaacacatgcaagtcgaggggcagcggggaggaagcttgctttctccgccggcgaccggcgcacgggtgagtaacacgtatgcaacctgcccctgtcagggggacaacccgccgaaaggcgggctaaacccgcgtacatgccaccggggcatcccggaggcaggaaaggcttcggccggacagggatgggcatgcggcgcattaggcagtaggcggggtaacggcccacctaaccgacgatgcgtaggggttctgagaggaaggtcccccacactggtactgagacacggaccagactcctacgggaggcagcagtgaggaatattggtcaatggtcgggagactgaaccagccaagccgcgtgagggatgacggccctacgggttgtaaacctcttttgccggggagcaaagagcgggacgcgtcccgcctcgagagtacccggagaaaaagcatcggctaactccgtgccagcagccgcggtaatacggaggatgcgagcgttatccggatttattgggtttaaagggtgcgcaggcggcgagttaagtcagcggtaaaatttcggggctcaaccccgacgagccgttgaaactggcttgctagagtgggcgagaagtatgcggaatgcgtggtgtagcggtgaaatgcatagatatcacgcagaactccgattgcgaaggcagcataccggcgcccaactgacgctcaggcacgaaagcgtgggtatcgaacaggattagataccctggtagtccacgcagtaaacgatgagcactaattgtccggtccgagtgagggctgggtgatacagcgaaagcgttaagtgctccacctggggagtacgccggcaacggtgaaactcaaaggaattgacgggggcccgcacaagcggaggaacatgtggtttaattcgatgatacgcgaggaaccttacccgggctcaaacggggagtgactcaggcagagacgcctgtttcccacgggacactccccgaggtgctgcatggttgtcgtcagctcgtgccgtgaggtgtcggcttaagtgccataacgagcgcaacccccgcgtgcagttgctaacagataacgctgaggactctgcacggactgccggcgcaagccgcgaggaaggcggggatgacgtcaaatcagcacggcccttacgtccggggcgacacacgtgttacaatgggtggtacagcgggaagccaggcggcgacgccgagcggaacccgaaatccactctcagttcggatcggagtctgcaacccgactccgtgaagctggattcgctagtaatcgcgcatcagccatggcgcggtgaatacgttcccgggccttgcacacaccgccc

SEQ ID NO: 857 - DNA, 1407 bp, Artificial Sequence; identical to SEQ ID NO: 46
  Synthetic Polynucleotide

SEQ ID NO: 858 - DNA, 1495 bp, Artificial Sequence; identical to SEQ ID NO: 224
  Synthetic Polynucleotide

SEQ ID NO: 859 - DNA, 1421 bp, Artificial Sequence; identical to SEQ ID NO: 245
  Synthetic Polynucleotide

SEQ ID NO: 860 - DNA, 1499 bp, Artificial Sequence
  Synthetic Polynucleotide
agagtttgatcctggctcaggatgaacgctagcgacaggcttaacacatgcaagtcgaggggcagcggaggtaagagcttgctcttacctgtcggcgaccggcgcacgggtgagtaacacgtatgcgacctgccctttgcaggaggataaccgggagaaattccgactaatactgcataataccgaggagctgcatggcttttcggtcaaaggaagcgattccggcaaaggatgggcatgcggcgcattagccagttggcggggtaacggcccaccaaagcgacgatgcgtaggggttctgagaggaaggtcccccacattggtactgagacacggaccaaactcctacgggaggcagcagtgaggaatattggtcaatgggcgagagcctgaaccagccaagtcgcgtgagggaagacggtcctatggattgtaaacctcttttgtcggggagcaaggccactcacgagtgagtggaaggagagtacccgaagaaaaagcatcggctaactccgtgccagcagccgcggtaatacggaggatgcgagcgttatccggatttattgggtttaaagggtgcgtaggcggactgttgagtcagcggtcaaatgtcggtgctcaacgccggcctgccgttgaaactggcggtcttgagtgagcgagaagtatgcggaatgcgtggtgtagcggtgaaatgcatagatatcacgcagaactccgattgcgaaggcagcataccggcgctcaactgacgctgaggcacgaaagcgtggggatcgaacaggattagataccctggtagtccacgcagtaaacgatgaatgctagatgtccgttgcttcggtgatgggtgtcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgtagatggaatatgtcggaaacgatatagctcttcggagccgtctacgaggtgctgcatggttgtcgtcagctcgtgccgtgaggtgtcggcttaagtgccataacgagcgcaacccctaccgacagttgctaacaagtagcgttgaggactctgtcgggactgccggcgcaagctgagaggaaggtggggatgacgtcaaatcagcacggcccttacgtccggggcgacacacgtgttacaatggcaggtacagcgggaggccatgcggcgacgcagagcagaacccgaaaacctgtctcagttcggattggagtctgcaacccgactccatgaagctggattcgctagtaatcgcgcatcagccacggcgcggtgaatacgttcccgggccttgtacacaccgcccgtcaagccatggaagccgggagtgcctgaagtgcgtgagcgcaagcagcgtcctaaggtaaaaccggtgactggggctaagtcgtaacaaggtaacc

SEQ ID NO: 861 - DNA, 1389 bp, Artificial Sequence; identical to SEQ ID NO: 240
  Synthetic Polynucleotide

SEQ ID NO: 862 - DNA, 1505 bp, Artificial Sequence; identical to SEQ ID NO: 96
  Synthetic Polynucleotide

SEQ ID NO: 863 - DNA, 1405 bp, Artificial Sequence; identical to SEQ ID NO: 119
  Synthetic Polynucleotide

SEQ ID NO: 864 - DNA, 1499 bp, Artificial Sequence
  Synthetic Polynucleotide
tagagtttgatcatggctcaggatgaacgctagcgacaggcttaacacatgcaagtcgaggggcagcggggaggtagcaatacttccgccggcgaccggcgcacgggtgagtaacacgtatggaacctgcccgtagcagggggataagcggaagaaattccgtctaataccgcgtaataactccgagaggcatctcatggagtttaaagggtaataccggctacggatggccatgcggcgcattagctagttggcggggtaacggcccaccaaggcgacgatgcgtaggggttctgagaggaaggtcccccacactggtactgagacacggaccagactcctacgggaggcagcagtgaggaatattggtcaatgggcgcgagcctgaaccagccaagtcgcgtgagggatgacggccctacgggttgtaaacctcttttgtcggggagcaaattccgccacgtgtggcggagtcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacacagtaaacgatgaatactaattgttcggggagaatgatccctgagtgatacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacacaggaatacttttgaaaggaagtagctctatggagcctgtgtcgaggtgctgcatggttgtcgtcagctcgtgccgtgaggtgtcggcttaagtgccataacgagcgcaacccccatcgccagttaccagcaagtcaagttggggactctggcgagactgccggcgcaagctgtgaggaaggcggggatgacgtcaaatcagcacggcccttacgtccggggcgacacacgtgttacaatggcaggtacagagagaagcaatgcggcgacgcaaagcggaacttgaaagcctgtctcagttcggattggagtctgcaactcgactccatgaagctggattcgctagtaatcgcgcatcagccatggcgcggtgaatacgttcccgggccttgtacacaccgcccgtcaagccatggaagccgggagtgcctgaagtgtgcaaccgcaaggagcgccctaaggtaaaactggtgactggggctaagtcgtaacaaggtaaccgta

SEQ ID NO: 865 - DNA, 1489 bp, Artificial Sequence; identical to SEQ ID NO: 107
  Synthetic Polynucleotide

SEQ ID NO: 866 - DNA, 1403 bp, Artificial Sequence
  Synthetic Polynucleotide
ttagagtttgttcctggctcaggatgaacgctagctacaggcttaacacatgcaagtcgtggggcagcatgaggtcagcttgctgactttgatggcgaccggcgcacgggtgagtaacgcgtatccaacctgccctatactcagggacagcccgtcgaaaggtggattaatacctgatgttattgtttgaaggcatctgatgacaatcaaagatttatcggtatgggatggggatgcgtctgattagcttgtcggcggggtaacggcccaccgaggcgacgatcagtaggggttctgagaggaaggtcccccacactggaactgagacacggtccagactcctacgggaggcagcagtgaggaatattggtcaatggatgagaatctgaaccagccaagtagcgtgcaggatgacggccctatgggttgtaaactgcttttatacgggaataaatgacgacacgtgtgttgttttgtaggtaccgtatgaataaggaccggctaactccgtgccagcagccgcggtaatacggagaatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattggataccctggtagtccacgcagtaaacgatgaatactagctgtccggggcgaatgagccctgggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacacaggaacggtcctgaaaggggtcggctctacggagcctgtgtcgaggtgctgcatggttgtcgtcagctcgtgccgtgaggtgtcggcttaagtgccataacgagcgcaacccccatcgacagttgctaacaggttaggctgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtctcagttcggattggagtctgcaacccgactccatgaagctggattcgctagtaatcgcgcatcagccacggcgcggtgaatacgtacccgggccttgcactcaccgcccgtca

SEQ ID NO: 867 - DNA, 1406 bp, Artificial Sequence
  Synthetic Polynucleotide
agagtttgattctggctcaggatgaacgctagcgacaggcctaacacatgcaagtcgaggggcatcggggcgaggagcaatccttgccgccggcgaccggcgcacgggtgagtaacgcgtatgcgacctgcccgttgcagggggataatcgggagaaatcccgtctaataccgcgtaatgccgcggggctgcatggccctgcggccaaagggagcgattccggcaacggatgggcatgcgtgacattagctagttggcggggcaacggcccaccaaggcgacgatgtctaggggttctgagaggaaggtcccccacactggtactgagacacggaccagactcctacgggaggcagcagtgaggaatattggtcaatgggcgcgagcctgaaccagccaagtcgcgtgagggatgacggccctacgggttgtaaacctcttttgtcggggagcaaattccgttacgtgtaacggagtcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagtataccggcgcccaactgacgctgaagcacgaaagcgtgggtatcgaacaggattagataccctggtagtccacgcagtaaacgatgaatactagctgtccggggcgaatgagccctgggtggcacagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgccaaaggacagccgctgaaaggcggcctccctccggggtctttggcgaggtgctgcatggttgtcgtcagctcgtgccgtgaggtgtcggcttaagtgccataacgagcgcaacccccatcgacagttgctaacgggtgatgccgaggactctgtcgagactgccggcgcaagctgcgaggaaggcggggatgacgtcaaatcagcacggcccttacgtccggggcgacacacgtgttacaatggccggtacagcgggatgccagggcgcgagcccgagcggaacccgaaaaccggtctcagttcggattggagtctgcaacccgactccatgaagctggattcgctagtaatcgcgcatcagccacggcgcggtgaatacgttcccgggccttgcacacaccgcccgtca

SEQ ID NO: 868 - DNA, 1415 bp, Artificial Sequence; identical to SEQ ID NO: 76
  Synthetic Polynucleotide

SEQ ID NO: 869 - DNA, 1406 bp, Artificial Sequence
  Synthetic Polynucleotide
agagtttgatcctggctcaggatgaactctagcgacaggcctaacacatgcaagtcgaggggcatcggggcgaggagcaatccttgccgccggcgaccggcgcacgggtgagtaacgcgtatgcgacctgcccgttgcagggggataatcgggagaaatcccgtctaataccgcgtaatgccgcggggctgcatggccctgcggccaaagggagcgattccggcaacggatgggcatgcgtgacattagctagttggcggggcaacggcccaccaaggcgacgatgtctaggggttctgagaggaaggtcccccacactggtactgagacacggaccagactcctacgggaggcagcagtgaggaatattggtcaatgggcgcgagcctgaaccagccaagtcgcgtgagggatgacggccctacgggttgtaaacctcttttgtcggggagcaaattccgttacgtgtaacggagtcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagtataccggcgcccaactgacgctgaagcacgaaagcgtgggtatcgaacaggattagataccctggtagtccacgcagtaaacgatgaatactagctgtccggggcgaatgagccctgggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacacaggaacgtacctgaaagggttcggctctacggagcccgtgtcgaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatgggaggtacagaaggccgctacctggcgacaggatgccaatccccaaaacctctctcagttcggatcgaagtctgcaacccgacttcgtgaagctggattcgctagtaatcgcgcatcagccatggcgcggtgaatacgttcccgggccttgcactcaccgcccgtca

SEQ ID NO: 870 - DNA, 1404 bp, Artificial Sequence
  Synthetic Polynucleotide
agagtttgatcctggctcaggatgaacgctagcgacaggcttaacacatgcaagtcgaggggcagcgggggagtggcaacacttccgccggcgaccggcgcacgggtgagtaacacgtatgaaacctgcccgcagcagggggataagcggaagaaattccgtctaataccgcgtaacaaccgacgggggcatccctgttggttcaaaggagcgatccggctgcggatgggcatgcggcgcattaggtagttggtggggcaacggcccaccaagccgacgatgcgtaggggttctgagaggaaggtcccccacattggaactgagacacggtccaaactcctacgggaggcagcagtgaggaatattggtcaatggccggaaggctgaaccagccaagtcgcgtgagggaataaggccctacgggtcgtaaacctcttttgccagggagcaatgccgtccacgtgtggacggaaggagagtacctggagaaaaagcatcggctaactccgtgccagcagccgcggtaatacggaggatgcgagcgttatccggatttattgggtttaaagggtgcgtaggcggcctgccaagtcagcggtaaaattgcggggctcaaccccgtacagccgttgaaactgccgggctcgagtgggcgagaagtatgcggaatgcgtggtgtagcggtgaaatgcatagatatcacgcagaaccccgattgcgaaggcagcataccggcgcccgactgacgctgaggcacgaaagcgtgggtatcgaacaggattagataccctggtagtccacgcagtaaacgatgaatactcgctgtccggggaaattggtctctgggcggccaagcgaaagcgttaagcattccacctggggagtacgccggcaacggtgaaactcaaaggaattgacgggggcccgcacaagcggaggaacatgtggtttaattcgatgatacgcgaggaaccttacccgggctcaaacgccgaagggacattccccgaaaggggattggccagcaatggtcttcggcgaggtgctgcatggttgtcgtcagctcgtgccgtgaggtgtcggcttaagtgccataacgagcgcaacccccaccgacagttgctaactggtcaagcagaggactctgtcgggactgccggcgcaagctgcgaggaaggcggggatgacgtcaaatcagcacggcccttacgtccggggcgacacacgtgttacaatggcaggtacagcgggatgccatggggcgacccagagcggaacccgaaaacctgtctcagttcggattggagtctgcaacccgactccatgaagctggattcgctagtaatcgcgcatcagccacggcgcggtgaatacgttcccgggccttgcacacaccgcccgtca

SEQ ID NO: 871 - DNA, 1501 bp, Artificial Sequence; identical to SEQ ID NO: 234
  Synthetic Polynucleotide

SEQ ID NO: 872 - DNA, 1495 bp, Artificial Sequence
  Synthetic Polynucleotide
agagtttgatcctggctcaggatgaacgctagcgacaggcttaacacatgcaagtcgaggggcagcgtggatgtagcaatacatctgacggcgaccggcgcacgggtgagtaacacgtatggaacctgcccccggccgggggataagcggaagaaattccgtctaataccgcataatgcagtactgaggcatctcagagctgccaaaggagcgatccggccggggatggacatgcggcgcattagttagttggcggggtaacggcccaccaaggcgacgatgcgtaggggttctgagaggaaggtcccccacattggaactgagacacggtccaaactcctacgggaggcagcagtgaggaatattggtcaatgggcggaagcctgaaccagccaagtcgcgtgagggaagacggtcctatggattgtaaacctcttttgcaggggagcaagacctgttacgtgtaacaggttggagagtaccctgagaaaaagcatcggctaactccgtgccagcagccgcggtaatacggaggatgcgagcgttatccggatttattgggtttaaagggtgcgtaggcgggctggtaagtcagcggtaaaaatgcggtgctcaacgccgtagtgccgttgaaactgccggtcttgagtgagcgagaagtatgcggaatgcgtggtgtagcggtgaaatgcatagatatcacgcagaactccgattgcgaaggcagcataccggcgctcaactgacgctgaggcacgaaagcgtggggatcgaacaggattagataccctggtagtccacgcagtaaacgatgaatgctaactgtccggaccgactgaggtctgagcggtaaagcgaaagcattaagcattccacctggggagtacgccggcaacggtgaaactcaaaggaattgacgggggcccgcacaagcggaggaacatgtggtttaattcgatgatacgcgaggaaccttacccgggctcaaacgtcaccggacggacagtgaaagctgtttttccttcgggaccggtgacgaggtgctgcatggttgtcgtcagctcgtgccgtgaggtgtcggcttaagtgccataacgagcgcaacccctatcgacagttgctaacaggcaaagctgaggactctgtcgagactgccggcgcaagctgtgaggaaggcggggatgacgtcaaatcagcacggcccttacgtccggggcgacacacgtgttacaatggcaggtacagcgggaagccacggggcgacccggagcagaacccgaaaacctgtctcagttcggattggagtctgcaacccgactccatgaagctggattcgctagtaatcgcgcatcagccacggcgcggtgaatacgttcccgggccttgtacacaccgcccgtcaagccatggaagccgggagtgcctgaagtgcgtcaccgcaaggaacgccctaaggtaaaaccggtgactggggctaagtcgtaacaaggtaacc

SEQ ID NO: 873 - DNA, 1401 bp, Artificial Sequence; identical to SEQ ID NO: 35
  Synthetic Polynucleotide

SEQ ID NO: 874 - DNA, 1408 bp, Artificial Sequence; identical to SEQ ID NO: 166
  Synthetic Polynucleotide

SEQ ID NO: 875 - DNA, 1448 bp, Artificial Sequence
  Synthetic Polynucleotide
acgctagcggcaggcttaacacatgcaagtcgaagggcagcgtgggaagtgcttgcacttcctgacggcgactggcgcacgggtgagtaacacgtatgcaacctgccccctgcagggggacaactttccgaaaggaaggctaatcccgcgtatattccggaggggcatccctccgggaggaaagattcatcggcaggggatgggcatgcggcgcattaggcagacggcggtgtaacggaccaccgtaccgacgatgcgtaggggttctgagaggaaggtcccccacactggtactgagacacggaccagactcctacgggaggcagcagtgaggaatattggtcaatgggcgggagcctgaaccagccaagccgcgtgagggatgaaggccctatgggtcgtaaacctcttttgtcagggaacaaaagcgagtatgcatacttgtctgagtgtacctgaagaaaaagcatcggctaactccgtgccagcagccgcggtaatacggaggatgcgagcgttatccggatttattgggtttaaagggtgcgtaggcggcgatgcaagtcagcggtaaaagcccggggctcaaccccggcgagccgttgaaactgcagtgctagagaaggcgagaggtacgcggaatgcgcagtgtagcggtgaaatgcttagatattgcgcagaactccgattgcgaaggcagcgtactggcgcctgactgacgctgaggcacgaaagcgtggggatcgaacaggattagataccctggtagtccacgcagtaaacgatgaatgccggctgttcgggatgattgagtcctgagcggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacggcggcggacagggacagagacgtcccctcctacgggccaccgccgaggtgctgcatggttgtcgccagctcgtgccgtgaggtgtcggcttaagtgccataacgagcgcaacccctgccggtagttgctaacggttaaagccgaggactctaccgggactgccggcgcaagccgtgaggaaggcggggatgacgtcaaatcagcacggcccttacgtccggggcgacacacgtgttacaatggtcggtacagagggaagccaggtggcgacaccgagcggaacccgaaagccggtctcagttcggatcggagtctgcaacccgactccgtgaagctggattcgctagtaatcgcgcatcagccatggcgcggtgaatacgttcccgggccttgtacacaccgcccgtcaagccatgggagccgagggcgcttgaagtgcgtcgccgcgaggcgcgccctagagcgaaatcggtgactggggcta

SEQ ID NO: 876 - DNA, 1503 bp, Artificial Sequence
  Synthetic Polynucleotide
ttagagtttgatcatggctcaggatgaacgctagcgacaggcttaacacatgcaagtcgaggggcagcggggaagtaagcttgcttacttccgccggcgaccggcgcacgggtgagtaacacgtatgcaacctggccgtcacagagggataaccgggagaaatcccgcctaataccgcataataccttccggggacatccccgggaggtcaaaggagagatccggtgacggatgggcatgcgccgcattagttagttggcggtgtaacggaccaccaagacgacgatgcgtaggggttctgagaggaaggtcccccacactggtactgagacacggaccagactcctacgggaggcagcagtgaggaatattggtcaatgggcgagagcctgaaccagccaagtcgcgtgagggaagacggtcctatggattgtaaacctcttttgccggggagcaaagagcggcacgtgtgccgcgccgagagtacccggagaaaaagcatcggctaactccgtgccagcagccgcggtaatacggaggatgcgagcgttatccggatttattgggtttaaagggtgcgcaggcggcsygttaagtcagcggtaaaatttcggggctcaaccccgacgagccgttgaaactggcgagctagagtgggcgagaagtatgcggaatgcgtggtgtagcggtgaaatgcatagatatcacgcagaactccgattgcgaaggcagcataccggcgcccaactgacgctcatgcacgaaagcgtgggtatcgaacaggattagataccctggtagtccacgcagtaaacgatgagcactaattgtccggagcgagtgagctctgggtgatacagcgaaagcgttaagtgctccacctggggagtacgccggcaacggtgaaactcaaaggaattgacgggggcccgcacaagcggaggaacatgtggtttaattcgatgatacgcgaggaaccttacccgggctcaaacgcggcgtgaatacttttgaaaggaggtagtcagcaatgacacgccgcgaggtgctgcatggttgtcgtcagctcgtgccgtgaggtgtcggcttaagtgccataacgagcgcaacccctaccgtcagttgccagcaggtrargctggggactctgacgggactgccggcgcaagctgcgaggaaggcggggatgacgtcaaatcagcacggcccttacgtccggggcgacacacgtgttacaatggcaggtacagcgggaagccacctggcgacagggcgcggaacccgaaaacctgtctcagttcggattggagtctgcaacccgactccatgaagctggattcgctagtaatcgcgcatcagccacggcgcggtgaatacgttcccgggccttgtacacaccgcccgtcaagccatggaagccgggagtgcctgaagtgcgtgaccgcaaggagcgccctaaggcaataccggtgactggggctaagtcgtaacaaggtaaccgta

SEQ ID NO: 877 - DNA, 1499 bp, Artificial Sequence; identical to SEQ ID NO: 108
  Synthetic Polynucleotide

SEQ ID NO: 878 - DNA, 1392 bp, Artificial Sequence; identical to SEQ ID NO: 143
  Synthetic Polynucleotide

SEQ ID NO: 879 - DNA, 1485 bp, Artificial Sequence
  Synthetic Polynucleotide
  misc_feature (968)..(968): n is a, c, g, or t
tggctcacgtagaacgctagcgacaggcctaacacatgcaagtcgaggggcatcggggcgaggagcaatccttgccgccggcgaccggcgcacgggtgagtaacgcgtatgcgacctgcccgttgcagggggataatcgggagaaatcccgtctaataccgcgtaataccgcggggctgcatggccctgcggccaaagggagcgattccggcaacggatgggcatgcgtgacattagctagttggcggggcaacggcccaccaaggcgacgatgtctaggggttctgagaggaaggtcccccacactggtactgagacacggaccagactcctacgggaggcagcgtgaggaatattggtcaatgggcgcgagcctgaaccagccaagtcgcgtgagggatgacggccctacgggttgtaaacctcttttgtcggggagcaaattccgccacgtgtggcggagtcaagagtacccgaagaaaaagcatcggctaactccgtgccagcagccgcggtaatacggaggatgcgagcgttatccggatttattgggtttaaagggtgcgtaggcggactgtcaagtcagcggtaaaatacgagggctcaacctccgcccgccgttgaaactgacggtcttgagtgggcgagaagtatgcggaatgcgtggtgtagcggtgaaatgcatagatatcacgcagaactccgattgcgaaggcagcataccggcgcccgactgacgctgaagcacgaaagcgtgggtatcgaacaggattagataccctggtagtccacgcagtaaacgatgaatactagctgtccggggcgaatgagccctgggtggcacagcgaaagcgttaagtattccacctggggagtacgccggcaacggcgaactcaaaaggaattgacgggggcccgcacaagcggaggaacatgtggtttaattcgatgatacgcgaggaacctancccgggctcaaacgacacaggaacgtacctgaaagggttcggctctacggagcctgtgtcgaggtgctgcatggttgtcgtcagctcgtgccgtgaggtgtcggcttaagtgccataacgagcgcaacccccatcgacagttgctaacaggtcaggctgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtctcagttcggattggagtctgcaacccgactccatgaagctggattcgctagtaatcgcgcatcagccacggcgcggtgaatacgttcccgggccttgtacacaccgcccgtcaagccatggaagccgggggtgcctgaagtgcgctgccgcgaggagcgccctagggtaaaaccggtgactggggctaagtcgtaacaaggtaac

SEQ ID NO: 880 - DNA, 1407 bp, Artificial Sequence
  Synthetic Polynucleotide
agagtttgatcctggctcaggatgaacgctagcgacaggcctaacacatgcaagtcgaggggcatcggggcgaggagcaatccttgccgccggcgaccggcgcacgggtgagtaacgcgtatgcgacctgcccgttgcagggggataatcgggagaaatcccgtctaataccgcgtaatgccgcggggctgcatggccctgcggccaaaggaagcgattccggcaacggatgggcatgcgtgacattagctagttggcggggcaacggcccaccaaggcgacgatgtctaggggttctgagaggaaggtcccccacactggtactgagacacggaccagactcctacgggaggcagcagtgaggaatattggtcaatgggcgcgagcctgaaccagccaagtcgcgtgagggatgacggccctacgggttgtaaacctcttttgtcggggagcaaattccgccacgcgtggcggaatcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatgatgattgtccggagggatggacctctgggtgaatacaggggaaagcgttaagcattccacctggggagtacgccggcaacggtgaaactcaaaggaattgacggggggcccgcacaaggcggaggaacatgtggtttaattcgatgatacgcgaggaaccttacccgggctcaaacggggagtgactcaggcaggagacgcctgtttcccacgggacactccccgaggtgctgcatggttgtcgtcagctcgtgccgtgaggtgtcggcttaagtgccataacgagcgcaacccccgcgtgcagttgctaacagataacgctgaggactctgcacggactgccggcgcaagccgcgaggaaggcggggatgacgtcaaatcagcacggcccttacgtccggggcgacacacgtgttacaatgggtggtacagcgggaagccaggcggcgacgccgagcggaacccgaaatccactctcagttcggatcggagtctgcaacccgactccgtgaagctggattcgctagtaatcgcgcatcagccatggcgcggtgaatacgttcccgggccttgcactcaccgccc

SEQ ID NO: 881 - DNA, 1446 bp, Artificial Sequence; identical to SEQ ID NO: 281
  Synthetic Polynucleotide

SEQ ID NO: 882 - DNA, 1410 bp, Artificial Sequence; identical to SEQ ID NO: 95
  Synthetic Polynucleotide

SEQ ID NO: 883 - DNA, 1498 bp, Artificial Sequence
  Synthetic Polynucleotide
agagtttgatcctggctcaggatgaacgctagcgacaggcttaacacatgcaagtcgaggggcagcggtaagggggcttgccttcttagccggcgaccggcgcacgggtgagtaacacgtatgcaacctgcccatcgcagggggataagcgggagaaattccgtctaataccgcgtaatatcccggggagacatctcttggggattaaaggaagcgattccggcgatggatgggcatgcggcgcattagttagttggcggggtaacggcccaccaaggcgacgatgcgtaggggttctgagaggaaggtcccccacactggtactgagacacggaccagactcctacgggaggcagcagtgaggaatattggtcaatgggcggtagcctgaaccagccaagtcgcgtgagggaagacggtcctatggattgtaaacctcttttgccggggagcaagaggcgccacgagtggcgtcgtgagagtacccggagaaaaagcatcggctaactccgtgccagcagccgcggtaatacggaggatgcgagcgttatccggatttattgggtttaaagggtgcgtaggccgtgagtcaagtcagcggtaaaattgagaggctcaacctcttcgagccgttgaaactgattcacttgagtgagcgagaagtatgcggaatgcgtggtgtagcggtgaaatgcatagatatcacgcagaactccgattgcgaaggcagcataccggcgctcaactgacgctgaagcacgaaagcgtggggatcaaacaggattagataccctggtagtccacgcagtaaacgatgattactaattgtccgggtcgaatgagacctgggtgatacagcgaaagcgttaagtaatccacctggggagtacgccggcaacggtgaaactcaaaggaattgacgggggcccgcacaagcggaggaacatgtggtttaattcgatgatacgcgaggaaccttacccgggctcaaacgcttccggaatgtcgctgaaaggcgacagccctacggggccgggagcgaggtgctgcatggttgtcgtcagctcgtgccgtgaggtgtcggcttaagtgccataacgagcgcaacccccatcgacagttgctaacagataatgctgaggactctgtcgagactgccggcgcaagctgagaggaaggcggggatgacgtcaaatcagcacggcccttacgtccggggcgacacacgtgttacaatggcaggcacagcgggaagccacggggcgacccggagcggaacccgaaagcctgtctcagttcggattggagtctgcaacccgactccatgaagttggattcgctagtaatcgcgcatcagccatggcgcggtgaatacgttcccgggccttgtacacaccgcccgtcaagccatggaagccgggagtgcctgaagtgcgtgaccgcaaggagcgccctaaggtaaaaccggtgactggggctaagtcgtaacaaggtaacc

SEQ ID NO: 884 - DNA, 1401 bp, Artificial Sequence
  Synthetic Polynucleotide
agagtttgatcctggctcaagatgaacgctagcgacaggcttaacacatgcaagtcgaggggcagcgggggagcagcaatgctcccgccggcgaccggcgcacgggtgagtaacacgtatggaacctgcccgcagcagggggataagcgaaagaaattccgtctaataccgcgtaacaccgcggaggggcatccctcggcggttaaagattcatcggctgcggatggccatgcggcgcattagctagtcggcggggtaacggccccaccgaggcgacgatgcgtaggggttctgagaggaaggtcccccacactggtactgagacacggaccagactcctacgggaggcagcagtgaggaatattggtcaatggccgggaggctgaaccagccaagtcgcgtgagggaagacggccctacgggttgtaaacctcttttgtcagggagcaagaggcgggtcgggacctgctgtgagagtacctgaagaaaaagcatcggctaactccgtgccagcagccgcggtaatacggaggatgcgagcgttatccggatttattgggtttaaagggtgcgcaggcggaggcacaagtcagcggtaaaatcgcggggctcaaccccgctccgccgttgaaactgtgtcccttgagtgcgcgaagggtaggcggaatgcgtggtgtagcggtgaaatgcatagatatcacgcagaactccgatcgcgaaggcagcctaccggcgcgcgactgacgctcatgcacgaaagcgtgggtatcgaacaggattagataccctggtagtccacgcagtaaacgatgaatgctatctgtccggccggaatgacggctgggtggcacagcgaaagcgttaagcattccaccccggggagtacgccggcaacggtgaaactcaaaggaattgacgggggcccgcacaagcggaggaacatgtggtttaattagatgatacgcgaggaaccttacccgggctcaaacgcaggagggatgtttttgaaaggaggcagccagcaatggtctcctgcgaggtgctgcatggttgtcgtcagctcgtgccgtgaggtgtcggcttaagtgccataacgagcgcaacccctacctacagttgccatcgcgtgatggcgggcactctgtggggactgcctgcgcaagcagtgaggaaggcggggatgatgtcaaatcagcacggcccttacgtccggggcgacacacgtgttacaatggcaggtacagcgggaagccacccggcgacggggcgcggaacccgaaaacctgtctcagttcggattggagtttgcaacccgactccatgaagctggattcgctagtaatcgcgcatcagccacggcgcggtgaatacgttcccgggccttgcacacaccgcccgtca

SEQ ID NO: 885 - DNA, 1505 bp, Artificial Sequence
  Synthetic Polynucleotide
tagagtttgatcctggctcaggatgaacgctagcgacaggcttaacacatgcaagtcgaggggcagcggggcggcaggcttgcctgccgttgccggcgaccggcgcacgggtgagtaacacgtatgcaacctgcccgtggcagggggataagcgggggaaaccccgtctaataccgcgtaacgcggcctagggacatcccaaggccgccaaagggagcaatcccggccacggatgggcatgcggcgcattagctagtcggcggggtaacggcccaccgaggcgacgatgcgtaggggttctgagaggaaggccccccacactggtactgagacacggaccagactcctacgggaggcagcagtgaggaatattggtcaatgggcgcgagcctgaaccagccaagtcgcgtgagggaggacggccctacgggttgtaaacctcttttgccggggagcaacgggcgtcacgtgtggcgccactgagagtacccggagaaaaagcatcggctaactccgtgccagcagccgcggtaatacggaggatgcgagcgttatccggatttattgggtttaaagggtgcgtaggcggcctgccaagtcagcggtaaaattgcggggctcaaccccgtacagccgttgaaactgccgggctcgagtgggcgagaagtatgcggaatgcgtggtgtagcggtgaaatgcatagatatcacgcagaaccccgattgcgaaggcagcataccggcgcccgactgacgctgaggcacgaaagtgcggggatcaaacaggattagataccctggtagtccgcacagtaaacgatgaatgctagctgtccggggggattgacccctgggtggcacagcgaaagcgttaagcattccacctggggagtacgccggcaacggtgaaactcaaaggaattgacgggggcccgcacaagcggaggaacatgtggtttaattcgatgatacacgaggaaccttacccgggctcaaacgacacaggaatacttttgaaaggaggtagctctacggagtctgtgtcgaggtgctgcatggttgtcgtcagctcgtgccgtgaggtgtcggcttaagtgccataacgagcgcaacccccatcgccagttaccagcaagtcaagttggggactctggcgagactgccggcgcaagctgtgaggaaggcggggatgacgtcaaatcagcacggcccttacgtccggggcgacacacgtgttacaatggcaggtacagagagaagcaatgcggcgacgcaaagcggaacttgaaagcctgtctcagttcggattggagtctgcaactcgactccatgaagctggattcgctagtaatcgcgcatcagccatggcgcggtgaatacgttcccgggccttgtacacaccgcccgtcaagccatggaagccgggagtgcctgaagtgtgcaaccgcaaggagcgccctaaggtaaaactggtgactggggctaagtcgtaacaaggtagccgta

SEQ ID NO: 886 - DNA, 1451 bp, Artificial Sequence; identical to SEQ ID NO: 28
  Synthetic Polynucleotide
  misc_feature (18)..(18): n is a, c, g, or t
  misc_feature (30)..(30): n is a, c, g, or t
  misc_feature (33)..(33): n is a, c, g, or t
  misc_feature (1048)..(1048): n is a, c, g, or t
  misc_feature (1054)..(1054): n is a, c, g, or t
  misc_feature (1057)..(1057): n is a, c, g, or t
  misc_feature (1235)..(1235): n is a, c, g, or t

SEQ ID NO: 887 - DNA, 1408 bp, Artificial Sequence
  Synthetic Polynucleotide
agagtttgatcctggctcaggatgaacgctagcgacaggcttaacacatgcaagtcgaggggcagcgggggtgagagcttgctctcacctgccggcgaccggcgcacgggtgagtaacacgtatgcaacctgccctttgcagggggataagcggaagaaattccgtctaataccgcataacaccccggggagacatctccccggggtcaaaggaggcaactccggcaaaggatgggcatgcggcgcattagctagtcggcggggtaacggcccaccgaggcgacgatgcgtaggggttctgagaggaaggtcccccacactggtactgagacacggaccagactcctacgggaggcagcagtgaggaatattggtcaatgggcgaaagcctgaaccagccaagtcgcgtgagggatgacggtcctatggattgtaaacctcttttgcaggggagcaaagccgcccacgtgtgggcggaaggagagtaccctgagaaaaagcatcggctaactccgtgccagcagccgcggtaatacggaggatgcgagcgttatccggatttattgggtttaaagggtgcgtaggcggattggtaagtcagcggtaaaaatgcggggctcaaccccgtagtgccgttgaaactgccggtcttgagtgagcgagaagtatgcggaatgcgtggtgtagcggtgaaatgcatagatatcacgcagaactccgattgcgaaggcagcataccggcgctcaactgacgctgaggcacgaaagcgtggggatcgaacaggattagataccctggtagtccacgcagtaaacgaggaatggtaggggtccgggagcttcgggtttggggggtacagcgaaagcgttaagcattccacctggggagtacgccggcaacggtgaaactcaaaggaaatggacgggggcccgcacaagcggaggaacatgtggtttaattcgatgatacgcgaggaaccttacccgggctcaaacgtagcaggaatacttttgaaaggaggtagcccttcggggcctgctacgaggtgctgcatggttgtcgtcagctcgtgccgtgaggtgtcggcttaagtgccataacgagcgcaacccctatcgacagttgctaacaggtagagctgaggactctgtcgagactgccggcgcaagctgtgaggaaggcggggatgacgtcaaatcagcacggcccttacgtccggggcgacacacgtgttacaatgggtggtacagcgggaagccatgtggcgacacagagcagaacccgaaagccactctcagttcggatcggagtctgcaacccgactccgtaaagctggattcgctagtaatcgcgcatcagccatggcgcggtgaatacgttcccgggccttgcacacaccgcccgtca

SEQ ID NO: 888 - DNA, 1505 bp, Artificial Sequence; identical to SEQ ID NO: 97
  Synthetic Polynucleotide

SEQ ID NO: 889 - DNA, 1410 bp, Artificial Sequence
  Synthetic Polynucleotide
agagtttgatcctggctcaggatgaacgctagcgacaggcctaacacatgcaagtcgaggggcatcggggagcgaagcttgctttgctccgccggcgaccggcgcacgggtgagtaacgcgtatgcaatctgcccgtttcagcgggataacccggagaaatccggcctaataccgcatgtggccgaggggaggcatcttctttcggccaaaggaggcgactccggagacggatgggcatgcgtgacattagctagttggcggggtaacggcccaccaaggcgacgatgtctaggggttctgagaggaaggtcccccacactggtactgagacacggaccagactcctacgggaggcagcagtgaggaatattggtcaatgggcgagagcctgaaccagccaagtcgcgtgaaggatgacggccctacgggttgtaaacttcttttgtcagggagcaattgggtccacgcgtgggcttagcgagagtacctgaagaaaaagcatcggctaactccgtgccagcagccgcggtaatacggaggatgcgagcgttatccggatttattgggtttaaagggtgcgtaggcggaatatcaagtcagcggtaaaaattcggggctcaaccccgtcgtgccgttgaaactggtgttcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatgctaattgtccggagggattgacctctgggtgatacagcgaaagcgttaagcattccacctgggtagtacgccggcaacggtgaaactcaaaggaattgacgggggcccgcacaagcggaggaacatgtggtttaattcgatgatacgcgaggaaccttacccgggctcaaacgccgcaggaaccgcccctgaaagggggcgggccagcaatggcctgcggcgaggtgctgcatggttgtcgtcagctcgtgccgtgaggtgtcggcttaagtgccataacgagcgcaacccccaccgacagttgctaactggtcaagcagaggactctgtcgggactgccggcgcaagctgcgaggaaggcggggatgacgtcaaatcagcacggcccttacgtccggggcgacacacgtgttacaatggcgggtacagcgggaagccacctggcgacagggcgcggaacccgaaaacccgtctcagttcggatcggagtctgcaacccgactccgtgaagctggattcgctagtaatcgcgcatcagccacggcgcggtgaatacgttcccgggccttgcacacaccgcccgtca

SEQ ID NO: 890 - DNA, 1402 bp, Artificial Sequence; identical to SEQ ID NO: 114
  Synthetic Polynucleotide

SEQ ID NO: 891 - DNA, 1415 bp, Artificial Sequence
  Synthetic Polynucleotide
agagtttgatcctggctcaggatgaacgctagctacaggcttaacacatgcaagtcgaggggcagcatggtcttagcttgctaaggctgatggcgaccggcgcacgggtgagtaacacgtatccaacctgccgtctactcttggccagccttctgaaaggaagattaatccaggatgggatcatgagttcacatgtccgcatgattaaaggtattttccggtagacgatggggatgcgttccattagatagtaggcggggtaacggcccacctagtcaacgatggataggggttctgagaggaaggtcccccacactggtactgagacacggaccagactcctacgggaggcagcagtgaggaatattggtcaatgggcgcgagcctgaaccagccaagtcgcgtgagggatgacggccctacgggttgtaaacctcttttgtcggggagcaaattccgccacgtgtggcggagtcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatactagctgtcccggggcgaatgaagccctgggggggcacagcgaaagcgttaagtattccacctggggagtacgccggcaacggtgaaactcaaagggaattagacgggggggccccgcacaagcggagggaacatgtggttttaattcgatgatacgcgagggaaccttacccgggctcaaacgacacaggaacgtacctgaaagggttcggctctacggagcctgtgtcgaggtgctgcatggttgtcgtcagctcgtgccgtgaggtgtcggcttaagtgccataacgagcgcaacccccatcgacagttgctaacgggtcaggctgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtttcagttcggattggagtctgcaacccgactccatgaagctggattcgctagtaatcgcgcatcagccacggcgcggtgaatacgttcccgggccttgcactcaccgcccgtca

SEQ ID NO: 892 - DNA, 1389 bp, Artificial Sequence
  Synthetic Polynucleotide
ctggctcaggatgaacgctagcggcaggcttaacacatgcaagtcgaggggcatcgggagggaagcttgctttccttgccggcgaccggcgcacgggtgagtaacacgtatgcaacctgcccgccacagggggataagcggaagaaattccgtctaataccgcgtgacgcggcaccggggcatcccggtgccgccaaagggattaccggtggcggatgggcatgcggcgcattagctagtcggcggggtaacggcccaccgaggcgacgatgcgtaggggttctgagaggaaggtcccccacactggtactgagacacggaccagactcctacgggaggcagcagtgaggaatattggtcaatgggcgcgagcctgaaccagccaagccgcgtgagggaagacggccctatgggttgtaaacctcttttgtcggagaacaaaacccgggacgagtcccggactgcgtgtatccgaagaaaaagcatcggctaactccgtgccagcagccgcggtaatacggaggatgcgagcgttatccggatttattgggtttaaagggtgcgtaggcggtctgttaagtcaacggtaaaattgcggggctcaaccccgtcgagccgttgaaactggcagacttgagttggcgagaagtacgcggaatgcgcggtgtagcggtgaaatgcatagatatcgcgcagaactccgattgcgaaggcagcgtaccggcgccagactgacgctgaggcacgaaagcgtggggatcgaacaggattagataccctggtagtccacgcagtaaacgatgaatgctggttgtccgggtcgaatgagacctgggcggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacgggagtggaatggaccagagacggttcagcctacgggccgcttccgaggtgctgcatggttgtcgtcagctcgtgccgtgaggtgtcggcttaagtgccataacgagcgcaacccccgccggcagttgctaacgggcaatgccgaggactctgccgggactgccgccgcaaggcgtgaggaaggcggggatgacgtcaaatcagcacggcccttacgtccggggcgacacacgtgttacaatgggcggtacagcgggaagccaggcggcgacgccgagcggaacccgaaagccgttctcagttcggatcggagtctgcaacccgactccgtgaagctggattcgctagtaatcgcgcatcagccatggcgcggtgaatacgttcccgggccttgcacacaccgcccgtca

SEQ ID NO: 893 - DNA, 1406 bp, Artificial Sequence
  Synthetic Polynucleotide
agagtttgatcatggctcaggatgaacgctagcgacaggcttaacacatgcaagtcgaggggcagcggtggtgaaggcttgccttcaccagccggcgaccggcgcacgggtgagtaacgcgtatgcgacctgcccgtcacagggggataatccggagaaatccggtctaataccgcataatatcgtgaagctgcatggttttgcgtttaaagggagcgattccggctacggatggtcatgcgtcgcattagcttgttggcggggtaacggcccaccaaggcgacgatgcgtaggggttctgagaggaaggtcccccacactggtactgagacacggaccagactcctacgggaggcagcagtgaggaatattggtcaatggccgcagggctgaaccagccaagtcgcgtgagggatgacggtcctatggattgtaaacctcttttgtcagggagcaaagggcgccacgtgtggcgttttgcgagtacctgaagaaaaagcatcggctaactccgtgccagcagccgcggtaatacggaggatgcgagcgttatccggatttattgggtttaaagggtgcgcaggcggaatgtcaagtcagcggtaaaatttcggggctcaaccccgtcgtgccgttgaaactggcgttcttgagtgagcgagaagtatgcggaatgcgtggtgtagcggtgaaatgcatagatatcacgcagaactccgattgcgaaggcagcataccggcgctcaactgacgctcatgcacgaaagcgtgggtatcgaacaggattagataccctggtagtccacgcagtaaacgatgaatactaactgtccgggcagaatgatgtctgggtggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacggatggatgtttctgaaaggaggcagcccttcggggcatccgtcgaggtgctgcatggttgtcgtcagctcgtgccgtgaggtgtcggcttaagtgccataacgagcgcaacccccatcgccagttaccagcaagtaaagttggggactctggcgagactgccggcgcaagctgtgaggaaggcggggatgacgtcaaatcagcacggcccttacgtccggggcgacacacgtgttacaatggcaggtacagagagaagcgatgcggcgacgcagagcggaacttcaaagcctgtctcagttcggattggagtctgcaacccgactccatgaagctggattcgctagtaatcgcgcatcagccacggcgcggtgaatacgttcccgggccttgtacacaccgcccgtc

SEQ ID NO: 894 - DNA, 1402 bp, Artificial Sequence; identical to SEQ ID NO: 83
  Synthetic Polynucleotide

SEQ ID NO: 895 - DNA, 1411 bp, Artificial Sequence; identical to SEQ ID NO: 79
  Synthetic Polynucleotide

SEQ ID NO: 896 - DNA, 1402 bp, Artificial Sequence; identical to SEQ ID NO: 187
  Synthetic Polynucleotide
  misc_feature (774)..(774): n is a, c, g, or t

SEQ ID NO: 897 - DNA, 1492 bp, Artificial Sequence
  Synthetic Polynucleotide
agagtttgatcctggctcaggatgaacgctagcggcaggcttaacacatgcaagtcgaggggcagcggggggagtgcttgcactccctgccggcgaccggcgcacgggtgagtaacacgtatgcaacctgcccctgtcagggggacaaccttccgaaagggaggctaatcccgcgtacatcctccgggggcatccccgggggaggaaagattcatcggacagggatgggcatgcggcgcattagctagttggcggggcaacggcccaccaaggcgacgatgcgtaggggttctgagaggaaggtcccccacactggtactgagacacggaccagactcctacgggaggcagcagtgaggaatattggtcaatgggagagatcctgaaccagccaagccgcgtgagggaagacggcactacgtgttgtaaacctcttttgccggggaacaaaagcggggacgcgtccccgtccgcgtgtacccggagaaaaagcatcggctaactccgtgccagcagccgcggtaatacggaggatgcgagcgttatccggatttattgggtttaaagggtgcgtaggcggttccttaagtaagcggtaaaatcgcggggctcaaccccgccgagccgtttagactgggggacttgagacggcgagaagtacgcggaatgcgcggcgtagcggtgaaatgcatagatatcgcgcagaactcccgattgcgaaggcagcgtaccggcgccgttctgacgctgaggcacgaaagcgtggggatcgaacaggattagataccctggtagtccacgcagtaaacgatgaatgctggttgtccgggccgactggggcctgggcggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacgggagcggaattgaccagagacggtcaagcctacgggtcgcttccgaggtgctgcatggttgtcgtcagctcgtgccgtgaggtgtcggcttaagtgccataacgagcgcaacccctgccgtcagttgctaacgggcaatgccgaggactctgacgggactgccgccgcaaggcgcgaggaaggcggggatgacgtcaaatcagcacggcccttacgtccggggcgacacacgtgttacaatggggggtacagcgggaagcgcggcggcgacgccaagcggaacccgaaagcccctctcagttcggatcggagtctgcaacccgactccgtgaagctggattcgctagtaatcgcgcatcagccatggcgcggtgaatacgttcccgggccttgtacacaccgcccgtcaagccatgggagccgggggtgcttgaagtgcgtcgccgtaaggcgcgccctagagcaaaaccggtgactggggctaagtcgtaacaaggtaacc

SEQ ID NO: 898 - DNA, 1404 bp, Artificial Sequence; identical to SEQ ID NO: 186
  Synthetic Polynucleotide
  misc_feature (795)..(795): n is a, c, g, or t

SEQ ID NO: 899 - DNA, 1509 bp, Artificial Sequence
  Synthetic Polynucleotide
tagagtttgatcctggctcaggatgaacgctagcgacaggcttaacacatgcaagtcgaggggcagcgggggtgatggcttgccatcacctgccggcgaccggcgcacgggtgagtaacacgtatgcaacctgccctccacagggggacaaccttccgaaagggaggctaatcccgcgtaaatctcgatggggcatcccattgagaggaaagcttcggcggtggaggatgggcatgcggcgcattagctagtcggcggggtaacggcccaccgaggcgacgatgcgtaggggttctgagaggaaggtcccccacactggtactgagacacggaccagactcctacgggaggcagcagtgaggaatattggtcaatgggcgggagcctgaaccagccaagccgcgtgagggaataaggccctatgggtcgtaaacctcttttgtcggggaacaaaagcggggacgcgtccccgtctgcgtgtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatactagctgtccggggcgaatgagccctgggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcaggagggatgtttttgaaaggaggcagccagcaatggtctcctgcgaggtgctgcatggttgtcgtcagctcgtgccgtgaggtgtcggcttaagtgccataacgagcgcaacccctacctacagttgccatcgcgtgatggcgggcactctgtggggactgcctgcgcaagcagtgaggaaggcggggatgacgtcaaatcagcacggcccttacgtccggggcgacacacgtgttacaatggcgtaaacaaagggaagcaggacggcgacgttgagcaaatcccagaaataacgtcccagttcggattgtagtctgcaacccgactacatgaagctggaatcgctagtaatcgcgaatcagaatgtcgcggtgaatacgttcccgggtcttgtacacaccgcccgtcacaccatgggagtcggaaatgcctgaagtcagtgacccaaccgtaaggagggagctgccgaaggtggagccggtaactggggtgaagtcgtaatcaaggtaaccgta

SEQ ID NO: 900 - DNA, 1364 bp, Artificial Sequence
  Synthetic Polynucleotide
gacgaacgctagcggcaggcttaacacatgcaagtcgaagggcagcgggggaggagcttgctcctcccgccggcgactggcgcacgggtgagtaacacgtatgcaacctgccctcttcagggggacaaccttccgaaagggaggctaatcccgcgtatatcccccgggggcatccccgggtgaggaaaggcttcggccggaagaggatgggcatgcggcgcattagcttgttggcggggcaacggcccaccaaggcgacgatgcgtaggggttctgagaggaaggtcccccacactggtactgatacacggaccagactcctacgggaggcagcagtgaggaatattggtcaatggccgagaggctgaaccagccaagccgcgtgaaggaagacggccctacgggttgtaaacttcttttgtcggggaacaaaagcggggatgcgtccccgtgtgagtgtacccgaagaaaaagcatcggctaactccgtgccagcagccgcggtaatacggaggatgcgagcgttatccggatttattgggtttaaagggtgcgtaggcggttgtttaagtcagcggtaaaattgcgggactcaaccccgtcgagccgttgaaactggatgacttgagttggagagaagtaggcggaatgcgcggtgtagcggtgaaatgcatagatatcgcgcagaactccgattgcgaaggcagcctaccggctccatactgacgctgaggcacgaaagcgtggggatcgaacaggattagataccctggtagtccacgcagtaaacgatgaatgctggttgtccggaataattgagttctgggcggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacggcggagggcgtctccagagacggagatttccttcgggacttccgccgaggtgctgcatggttgtcgtcagctcgtgccgtgaggtgtcggcttaagtgccataacgagcgcaacccccgccgacagttgctaactggtgaagcagaggactctgtcgggactgccggcgcaagccgtgaggaaggcggggatgacgtcaaatcagcacggcccttacgtccggggcgacacacgtgttacaatggccggtacagcgggaagccaggcggcgacgccgagcggaacccgaaagccggtctcagttcggatcggagtctgcaacccgtctccgtgaagctggattcgctagtaatcgcgcatcagccatggcgcggtgaatacgttcccgggcct

SEQ ID NO: 901 - DNA, 1405 bp, Artificial Sequence
  Synthetic Polynucleotide
agagtttgatcctggctcaggatgaacgctagcgacaggcttaacacatgcaagtcgaggggcagcgggggcgaagcttgcttcgcctgccggcgaccggcgcacgggtgagtaacacgtatgcgacctgccccccgcagggggataaccgggagaaatcccgactaataccgcgtaacgccgctgggctgcatggcccggcggccaaaggaagcgattccggcgggggatgggcatgcggcgcattagctggtcggcggggtaacggcccaccgaggcgacgatgcgtaggggttctgagaggaaggccccccacactggtactgagacacggaccagactcctacgggaggcagcagtgaggaatattggtcaatgggcgggagcctgaaccagccaagccgcgtgagggaagaaggtacagcgtatcgtaaacctcttttgtcagggaacaaaggcggggactagtccccggatgagggtaattgaagaaaaagcatcggctaactccgtgccagcagccgcggtaatacggaggatgcgagcgttatccggatttattgggtttaaagggtgcgcaggcggcctgttaagtcagcggtaaaagcccggggctcaaccccggcgagccgttgaaactggcgggctggagttggagagaagtacgcggaatgcgcggtgtagcggtgaaatgcttagatatcgcgcagaaccccgattgcgaaggcagcgtaccggctccacactgacgctgaggcacgaaagcgtgggtatcgaacaggattagataccctggtagtccacgcagtaaacgatgaatgcttgctgtccgggcagagatatgcctggggggcgaagcgaaagcgataagcattccacctggggagtacgccggcaacggtgaaactcaaaggaattgacgggggcccgcacaagcggaggaacatgtggtttaattcgatgatacgcgaggaaccttacccgggctcaaacgggagacggcaggggcagagacgcccctttccctcgggacgtcttccgaggtgctgcatggttgtcgtcagctcgtgccgtgaggtgtcggcttaagtgccataacgagcgcaacccccgcgtgcagttgccagcaggaaaggctggggactctgcacggactgccggcgcaagccgcgaggaaggcggggatgacgtcaaatcagcacggcccttacgtccggggcgacacacgtgttacaatggggggtacagcgggaagccaggcggcgacgccgagcggaacccgaaagcccctctcagttcggaacggagtctgcaacccgactccgtgaagctggattcgctagtaatcgcgcatcagccatggcgcggtgaataaaatcccgggccttgtacacaccgcccgtca

SEQ ID NO: 902 - DNA, 1455 bp, Artificial Sequence; identical to SEQ ID NO: 30
  Synthetic Polynucleotide

SEQ ID NO: 903 - DNA, 1503 bp, Artificial Sequence
  Synthetic Polynucleotide
tagagtttgatcatggctcaggatgaacgctagcgacaggcttaacacatgcaagtcgaggggcagcgggggcggaagcttgctttcgcccgccggcgaccggcgcacgggtgagtaacacgtatgcaacctggccgccacagggggataacccgcggaaacgcggcctaataccccgtgacgccaccggagggcatcctccggtggccaaaggagtgatccggtggcggatgggcatgcggcgcattagctagacggcggggtgacggcccaccgtggcgacgatgcgtaggggttctgagaggaaggtcccccacactggtactgagacacggaccagactcctacgggaggcagcagtgaggaatattggtcaatgggcgcgagcctgaaccagccaagtcgcgtgagggatgacggccctacgggttgtaaacctcttttgtcggggagcaaattccgccacgtgtggcggagtcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatactagctgtccggggcgaatgagccctgggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacacaggaacgtacctgaaagggttcggctctacggagcctgtgtcgaggtgctgcatggttgtcgtcagctcgtgccgtgaggtgtcggcttaagtgccataacgagcgcaacccccatcgacagttgctaacaggtcaggctgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtctcagttcggattggagtctgcaacccgactccatgaagctggattcgctagtaatcgcgcatcagccacggcgcggtgaatacgttcccgggccttgtacacaccgcccgtcaagccatggaagccgggggtgcctgaagtgcgctgccgcgaggagcgccctagggtaaaaccggtgactggggctaagtcgtaacaaggtagccgta

SEQ ID NO: 904 - DNA, 1401 bp, Artificial Sequence
  Synthetic Polynucleotide
agagtttgatcctggctcaggatgaacactagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatactagctgtccggggcgaatgagccctgggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacacaggaacgtacctgaaagggttcggctctacggagcctgtgtcgaggtgctgcatggttgtcgtcagctcgtgccgtgaggtgtcggcttaagtgccataacgagcgcaacccccatcgacagttgctaacaggtcaggctgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtctcagttcggattggagtctgcaacccgactccatgaagctggattcgctagtaatcgcgcatcagccacggcgcggtgaatacgttcccgggccttgcacacaccgcccgtca

SEQ ID NO: 905 - DNA, 1396 bp, Artificial Sequence
  Synthetic Polynucleotide
  misc_feature (855)..(855): n is a, c, g, or t
  misc_feature (951)..(952): n is a, c, g, or t
agagtttgatcctggctcaggatcaatgctagcgacaggcttaacacatgcaagtcgaggggcagcgggggtgcaggcttgcctgcacctgccggcgaccggcgcacgggtgagtaacacgtatggaacctgcccgccacagggggataacccggggaaacccggcctaataccccatgccgcccggaccgggcatccggtccgggcgaaaggaggaatccggtggcggctgggcatgcggcgcattagcttgacggcggggtaacggcccaccgtggcgacgatgcgtaggggttctgagaggaaggccccccacactggaactgagacacggtccagactcctacgggaggcagcagtgaggaatattggtcaatgggcggaagcctgaaccagccaagtcgcgtgagggaataaggccctacgggtcgtaaacctcttttgccggggagcaagggcggggacgtgtcccggcccggagagtacccggagaaaaagcatcggctaactccgtgccagcagccgcggtaatacggaggatgcgagcgttatccggatttattgggtttaaagggtgcgtaggcgggcttttaagtcagcggtaaaaattcggggctcaaccccgtccggccgttgaaactgggggccttgagtgggcgagaagaaggcggaatgcgtggtgtagcggtgaaatgcatagatatcacgcagaaccccgattgcgaaggcagccttccggcgccctactgacgctgaggcacgaaagtgcggggatcgaacaggattagataccctggtagtccgcacagtaaacgatggatgccagctgtccgggccaaatggggcgatggctgngtgcaagcgaagcgtagcatcccacctggggagtacgccggcaacggtgaaaactcaaaggaattgacgggggcccgcacaagcggaggaacatgnnctgtggttatcgatgatacgcgagggaccttacccgggctcaaacgcgtcagggatccccttcgaaaggaggggagtcagccaatgacctggcgcgaggtgctgcatggtttgtcgtcagctcgtgccgtgaggtgtcggcttaagtgccataacgagcgcaacccctaccgacagttgctaactggtgaagcagaggactctgtcgggactgccggcgcaagctgcgaggaaggcggggatgacgtcaaatcagcacggcccttacgtccggggcgacacacgtgttacaatggcaggtacagcgggaagccaccgggcgaccgggcgcggaacccgaaaacctgtctcagttcggatcggagtctgcaacccgactccgtgaagctggattcgctagtaatcacgcatcagccacggcgcggtgaatacgttcccgggcctt

SEQ ID NO: 906 - DNA, 1404 bp, Artificial Sequence
  Synthetic Polynucleotide
agagtttgatcctggcacaggatgaacgctagcggcaggcttaacacatgcaagtcgaggggcagcgggaggaaagcttgctttccttgccggcgaccggcgcacgggtgagtaacacgtatgcaacctgcccttcccagggggacaaccttccgaaagggaggctaatcccgcgtatatcctccggaggcatctccggaggaggaaagattcatcgggggaggatgggcatgcggcgcattagctagacggcggggtaacggcccaccgtggcgacgatgcgtaggggttctgagaggaaggtcccccacactggtactgagacacggaccagactcctacgggaggcagcagtgaggaatattggtcaatggaagagattctgaaccagccaagccgcgtgagggaagacggccctacgggttgtaaacctcttttgtcggggagcaaattccgccacgcgtggcggggtcgagagtacccgaagaaaaagcatcggctaactccgtgccagcagccgcggtaatacggaggatgcgagcgttatccggatttattgggtttaaagggtgcgtaggcggactgtcaagttagcggtaaaatacgggggctcaacctccgcccgccgttgaaactgacggtcttgagtgggcgagaagtatgcggaatgcgtggtgtagcggtgaaatgcatagatatcacgcagaactccgattgcgaaggcagcataccggcgcccaactgacgctgaagcacgaaagcgtgggtatcgaacaggattagataccctggtagtccacgcagtaaacgatgaatactagctgtccggggcgaaatgaacccctggggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacacaggaacggtcctgaagggggtcggctctacggagcctgtgtcgaggtgctgcatggttgtcgtcagctcgtgccgtgaggtgtcggcttaagtgccataacgagcgcaacccccatcgacagttgctaacaggttaggctgaggactctgtcgagactgccggcgcaagctgcgaggaaggcggggatgacgtcaaatcagcacggcccttacgtccggggcgacacacgtgttacaatggcaggtacagcgggaagccacctggcgacagggagcggaacccgaaagcctgtctcagttcggattggagtctgcaacccgactccatgaagctggattcgctagtaatcgcgcatcagccacggcgcggtgaatacgttcccgggccttgcacacaaagcccgtca

SEQ ID NO: 907 - DNA, 1478 bp, Artificial Sequence
  Synthetic Polynucleotide
tcctggctcaggatgaacgctagcgataggcttaacacatgcaagtcgaggggcagcgagcgagatagcaatatcttgtgtcggcgaccggcgcactggtgagtaacacgtatgcaacctgccctctacagggggataatccggagaaattcggtctaatatcccatagtccctgagtttgcatgagcttagggggaaagttccggcggtagaggatgggcatgcggcgcattagctggttggcggggtaacggcccaccaaggcgacgatgcgtaggggttctgagaggaaggtcccccacactggtactgagacacggaccagactcctacgggaggcagcagtgaggaatattggtcaatgggcgcgagcctgaaccagccaagtcgcgtgagggacgacggtcctacggattgtaaacctctttaggcggggagtaatgtgctctacgagtagagtagtgagagtacccgcagaataagcatcggctaactccgtgccagcagccgcggtaatacggaggatgcgagcgttatccggatttattgggtttaaagggtgcgcaggctgtgcatcaagtcagcggtaaaatctcggggctcaaccccgtttagccgttgaaactggtgtactggagtgtgcgcgaggaaggcggaatgcgcggtgtagcggtgaaatgcatagatattgcgcagaactccgattgcgaaggcagccttccagtgcatgactgacgctgaggcacgaaagcgtgggtatcgaacaggattagataccctggtagtccacgcagtaaacgatgaatactatctttccgtcgcgcttgagcggggggaggacaagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgctgatagaccggtgtggaaacacgccttcccttcggggctgtcagcgaggtgctgcatggttgtcgtcagctcgtgccgtgaggtgtcggcttaagtgccataacgagcgcaacccccatctccagttgccatcggttaaagccgggcactctggagagactgccggcgcaagccgtgaggagggcggggatgacgtcaaatcagcacggcccttacgtccggggcgacacacgtgttacaatggcggagttacagcgggaagccaggcggcgacgtcgagctgatcccgaaaatccgtctcagttcggatcggagtctgcaacccgactccgtgaagctggattcgctagtaatcgcgcatcagccatggcgcggtgaatacgttcccgggccttgtacacaccgcccgtcaagccatggaagcttggagtgcctgaagttcgtgaccgcaaggagcgaccaagggtaagacaggtgactggggctaagtcgtaaca

SEQ ID NO: 908 - DNA, 1393 bp, Artificial Sequence
  Synthetic Polynucleotide
agagtttgatcctggctcaggatgaacgctagcgacaggcttaacacatgcaagtcgaggggcagcgagggagtggcaacacttctgtcggcgaccggcgcacgggtgagtaacgcgtatgcaacctgcccttcacagggggataaccgggagaaattccgactaataccgcatacgtcctccgggggcatccccgggggatgaaagaattatcggtgaaggatgggcatgcgtgatattaggtagttggcggggcaacggcccaccaagcccacgatatctaggggttctgagaggaaggtcccccacattggtactgagacacggaccaaactcctacgggaggcagcagtgaggaatattggtcaatggacgagagtctgaaccagccaagtcgcgtgaaggaagacggatctatggtttgtaaacttctttagtgcgggaacaaagcggtgtcgtgacgccggatgagtgtaccgcaagaataagcatcggctaactccgtgccagcagccgcggtaatacggaggatgcgagcgttatccggatttattgggtttaaagggagcgcaggctgcgaggcaagtcagcggtcaaatgtcggggctcaaccccggcctgccgttgaaactgtcctgctagagttcgagtgaggtatgcggaatgcgttgtgtagcggtgaaatgcatagatatgacgcagaactccgattgcgaaggcagcataccaactcgcgactgacgctgaggctcgaaagcgtgggtatcgaacaggattagataccctggtagtccacgcagtaaacgatgaatactaactgttcggagggcgacctctgagtggtaaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttccgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgcacacaccgcccgtca

SEQ ID NO: 909 - DNA, 1407 bp, Artificial Sequence
  Synthetic Polynucleotide
agagtttgatcctggctcaggatgaacgctagcgacaggcctaacacatgcaagtcgaggggcatcggggcgaggagcaatccttgccgccggcgaccggcgcacgggtgagtaacgcgtatgcgacctgcccgttgcagggggataatcgggagaaatcccgtctaataccgcgtaatgccgcggggctacatggccctgcggccaaaggaagcgattccggcaacggatgggcatgcgtgacattagctagttggcggggcaacggcccaccaaggcgacgatgtctaggggttctgagaggaaggtcccccacactggtactgagacacggaccagactcctacgggaggcggcagtgaggaatattggtcaatgggcgcgagcctgaaccagccaagtcgcgtgagggatgacggccctacgggttgtaaacctcttttgtcggggagcaaattccgccacgcgtggcggggtcgagagtacccgaagaaaaagcatcggctaactccgtgccagcagccgcggtaatacggaggatgcgagcgttatccggatttattgggtttaaagggtgcgtaggcggactgtcaagtcagcggtaaaatacgggggctcaacctccgcccgccgttgaaactgacggtcttgagtgggcgagaagtatgcggaatgcgtggtgtagcggtgaaatgcatggatatcacgcagaactccgattgcgaaggcagcataccggcgcccaactgacgctgaagcacgaaagcgtgggtatcgaacaggattagataccctggtagtccacgcagtaaacgatgaatactagctgtccggggcgaatgagccctgggtggcacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacggatgaatacttttgaaaggaggtagtccttcgggacatccgtcgaggtgctgcatggttgtcgtcagctcgtgccgtgaggtgccggcttaagtgccataacgagcgcaacccccatcgccagttgccaacaggtaaagctgggaactctggcgagactgccggcgcaagctgtgaggaaggcggggatgacgtcaaatcagcacggcccttacgtccggggcgacacacgtgttacaatagcaggtacagagagatgcgacacggcgacgtggagcggaactgtcaaaacctgtctcagttcggatcggagtctgcaacccgactccgtgaagctggattcgctagtaatcgcgcatcagccatggcgcggtgaatacgttcccgggccttgcacacaccgcccgtca

SEQ ID NO: 910 - DNA, 1494 bp, Artificial Sequence; identical to SEQ ID NO: 169
  Synthetic Polynucleotide

SEQ ID NO: 911 - DNA, 1507 bp, Artificial Sequence; identical to SEQ ID NO: 105
  Synthetic Polynucleotide

SEQ ID NO: 912 - DNA, 1402 bp, Artificial Sequence; identical to SEQ ID NO: 34
  Synthetic Polynucleotide

SEQ ID NO: 913 - DNA, 1408 bp, Artificial Sequence; identical to SEQ ID NO: 188
  Synthetic Polynucleotide

SEQ ID NO: 914 - DNA, 1370 bp, Artificial Sequence; identical to SEQ ID NO: 142
  Synthetic Polynucleotide

SEQ ID NO: 915 - DNA, 1370 bp, Artificial Sequence
  Synthetic Polynucleotide
agagtttgattctggctcaggatgaacgctagcgacaggcctaacacatgcaagtcgaggggcaacatggtatcagcttgctgatactgatggcgaccggcgcacgggtgagtaacgcgtatgtaatctacctgtaacagagggataacccggagaaatccggactaatacctcatagcacatattattcgcatgaattttatgttaaagagactcggttacagatgaacatgcgttccattagctagttggcggggttacggcccaccaaggcaacgatggataggggttctgagaggaaggtcccccacactggtactgagacacggaccagactcctacgggaggcagcagtgaggaatattggtcaatgggcgaaagcctgaaccagccaagtcgcgtggaggaagacggccctacgggttgtaaactccttttacctgggaataacgggcgctacgtgtagcgctgtgcaagtaccgggagaataagcatcggctaattccgtgccagcagccgcggtaatacggaagatgcgagcgttatccggatttattgggtttaaagggtgcgtaagcggaagaataagtcagcggtgaaatgcttcagctcaactggagaattgccgatgaaactgtttttctagagtataaaagaggtatgcggaatgcgtggtgtagcggtgaaatgcatagatatcacgcagaaccccgatttcgaaggcagcatactgggctataactgacgctgaagcacgaaagcgtgggtatcgaacaggattaggtaccctggtagtccacgccgtaaacgctgaaaggtaaactgtttgcgatataaagtaagcggtacagcgaaagaggtcaagtattccccctggggagtacgccggcaacggtgaaaaatcaaaggaattgacgggggcccgcacaagcggaggaacatgtggtttaatttgatgatacgcgaggaacctttacccgggctcaaacgacaggggaataatcccgaaaaggataaacctgcaatggccgctgtcgaggtgctgcatggttgtcgtcagctcgtgccgtgaggtgtcggcttaagtgccataacgagcgcaacccttcccggtagttattaacaggtcaagctgaggactctaccgggactgccagcgcaagctgtgaggaaggtggggaggacgtcaaatcagcacggcccttacgtccggggcgacacacgtgttacaatggcaggtacagagagtcgcgtcgtagcaatacgtagccaatcccgaaaacctgtctcagttcggatcggagtctgtaactcgactccgtgaagctggattcgctagtaatcgcgcatcagccatggcgcggtgaata

SEQ ID NO: 916 - DNA, 1461 bp, Artificial Sequence
  Synthetic Polynucleotide
tcaggatgaacgctagcgacaggcctaacacatgcaagtcgaggggcagcgcggaggtagcaatacttctggcggcgaccggcgcacgggtgagtaacacgtatgcaatctgcctgtaacagggggataacccggagaaatccggcctaataccccataacgacatatcttcgcatggggagatgtctaaagagagcaatcttggttacagatgagcatgcggtccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgaaggaagacggccctacgggttgtaaacttcttttgtcggagagtaaagtgcgctacgcgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaatgcccgggcttaacccgggagctgccgttgaaactgcgagctagcgtgcacaagaggcaggcggaatgcgtggtgtagcggtgaaatgcatagatatcacgcagaaccccgattgcgaaggcagcctgctagggtgcaacggacgctgaggcacgaaagcgtggggatcgaacaggattagataccctggtagtccacgcagtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgcagggggaatatgggtgaaagtccatagccagcaatggtcgcctgcgaggtgctgcatggttgtcgtcagctcgtgccgtgaggtgtcggcttaagtgccataacgagcgcaaccctattgacagttactaacgggtcaagccgaggactctgtcgagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaactcgactccatgaagctggattcgctagtaatcgcgcatcagccatggcgcggtgaatacgttcccgggccttgtacacaccgcccgtcaagccatggaagccgggagtacctgaagcatgcaaccgcaaggagcgtacgaaggtaataccggtaactggggctaagtc

SEQ ID NO: 917 - DNA, 1453 bp, Artificial Sequence
  Synthetic Polynucleotide
atgaacgctagcgacaggcctaacacatgcaagtcgaggggcagcatggtatcagcttgctgataccgatggcgaccggcgcacgggtgagtaacgcgtatgtaatctgcctgtaacagagggataacccggagaaatccggcctaatacctcataatacatattattcgcatgagttttatgttaaagaaatttggttacagatgaacatgcgttccattagctagttggcggggtaacggcccaccaaggcgacgatggataggggttctgagaggaaggtcccccacactggtactgagacacggaccagactcctacgggaggcagcagtgaggaatattggtcaatgggcgagagcctgaaccagccaagtcgcgtggaggaagactgccctacgggttgtaaactccttttacctgggaataacgggcgttacgtgtaatgcagtgcaagtaccaggagaataagcatcggctaattccgtgccagcagccgcggtaatacggaagatgcgagcgttatccggatttattgggtttaaagggtgcgtaggcggaagaataagtcagcggtgaaatgcttcagcttaactggagaattgccgatgaaactgtttttctagagtataaaagaggtatgcggaatgcgtggtgtagcggtgaaatgcatagatatcacgcagaaccccgattgcgaaggcagcatactgggctataactgacgctgaagcacgaaagcgtgggtatcgaacaggattagataccctggtagtccacgccgtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacaggggaatggccccgaaaagggtcagccagcaatggtcgctgtcgaggtgctgcatggttgtcgtcagctcgtgccgtgaggtgtcggcttaagtgccataacgagcgcaacccttaccggtagttactaacaggtcaagctgaggactctaccgggactgccagcgcaagctgtgaggaaggtggggatgacgtcaaatcagcacggcccttacgtccggggcgacacacgtgttacaatggcaggtacagagagtcgcggcgtagcaatacgtagccaatccccaaaacctgtctcagttcggatcggagtctgcaactcgactccgtgaagctggattcgctagtaatcgcgcatcagccatggcgcggtgaatacgttcccgggccttgtacacaccgcccgtcaagccatgggagccgggagtacctgaagtatgcaaccgcaaggagcgtcctagggtaatactggtgactggggctaag

SEQ ID NO: 918 - DNA, 1439 bp, Artificial Sequence; identical to SEQ ID NO: 244
  Synthetic Polynucleotide

SEQ ID NO: 919 - DNA, 1451 bp, Artificial Sequence; identical to SEQ ID NO: 272
  Synthetic Polynucleotide

SEQ ID NO: 920 - DNA, 1452 bp, Artificial Sequence; identical to SEQ ID NO: 303
  Synthetic Polynucleotide

SEQ ID NO: 921 - DNA, 1396 bp, Artificial Sequence; identical to SEQ ID NO: 130
  Synthetic Polynucleotide

SEQ ID NO: 922 - DNA, 1383 bp, Artificial Sequence
  Synthetic Polynucleotide
cctggctcaggatgaacgctagcgacaggcctaacacatgcaagtcgaggggcaacatggtatcagcttgctgataccgatggcgaccggcgcacgggtgagtaacgcgtatgtaatctacctgtaacagagggataacccggagaaatccggactaatacctcatagcacatattattcgcatgaattttatgttaaagagactcggttacagatgaacatgcgttccattagctggttggcggggtcacggcccaccaaggcaacgatggataggggttctgagaggaaggtcccccacactggtactgagacacggaccagactcctacgggaggcagcagtgaggaatattggtcaatgggcggaagcctgaaccagccaagtcgcgtggaggaagacggccctacgggttgtaaactccttttacctgggaataacgggcgctacgcgtagcgctgtgcaagtaccgggagaataagcatcggctaattccgtgccagcagccgcggtaatacggaagatgcgagcgttatccggatttattgggtttaaagggtgcgtaggcggaagaataagtcagcggtgaaatgcttcagctcaactggagaattgccgatgaaactgtttttctagagtataaaagaggtatgcggaatgcgtggtgtagcggtgaaatgcatagatatcacgcagaacctcgattgcgaaggcagcatactgggctataactgacgctgaagcacgaaagcgtgggtatcgaacaggattagataccctggtagttcacgccgtacacgatgaatactcactgtttgcgatataatgtaagctgtacagcgaaagcgttaagtattgcacctggggagtacgccggcaacggtgaaactcaaaggaattgacgggggcccgcacaagcggaggaacatgtggtttaattcgatgatacgcgaggaaccttacccgggctcaaacggcaggggaataatcccgaaaaggattagccagcaatggtcgctgtcgaggtgcagcatggttgtcgtcagctcgtcccgtgaggtgtcggcttaagtgccataacgagcgcaacccttaccggtagttactaacaggtcaagctgaggactctaccgggactgccagcgcaagctgtgaggaaggtggggatgacgtcaaatcagcacggcccttacgtccggggcgacacacgtgttacaatggcaggtacagagagtcgcttcgtagcaatacgtagccaatcccaaaaacctgtctcagttcggatcggagtctgcaactcgactccgtgaagctggattcgctagtaatcgcgcatcagccatggcgcggtgaatacgttcccaggccttgtacacaccgccc

SEQ ID NO: 923 - DNA, 1402 bp, Artificial Sequence; identical to SEQ ID NO: 64
  Synthetic Polynucleotide

SEQ ID NO: 924 - DNA, 1393 bp, Artificial Sequence; identical to SEQ ID NO: 57
  Synthetic Polynucleotide

SEQ ID NO: 925 - DNA, 1441 bp, Artificial Sequence; identical to SEQ ID NO: 231
  Synthetic Polynucleotide

SEQ ID NO: 926 - DNA, 1436 bp, Artificial Sequence
  Synthetic Polynucleotide
gcgacaggcctaacacatgcaagtcgaggggcagcggagaggtagcaatacctttgccggcgaccggcgcacgggtgagtaacacgtatgcaatccacctgtaacagggggataacccggagaaatccggactaataccccataatatgggctctccgcatggagggtccattaaagagagcaattttggttacagacgagcatgcgctccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtacgctacgtgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaattttcgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgcgggcccgcacaagcggaggaacatgtggtttaattggatgatacgcgaggaaccttacccgggttcaaacgcagggggaatatatatgaatgtatatagctagcaatactcacgtgggaggtgcttcatggttgtcgtcagctcgtgccgtgaggtgttggctcaagtgccataacgagcgcaacccctgtccatagttgccatcaggtcgttctgggcactctgtggagactgcctccgtaaggtgtgaggaaggtggggatgacgtcaaatcagcacgtcccttacgtccggggctacacacgtgttacaatggggcatacagcgacttggatgtgcgcaagaacgtccggatcaataaagtgcctgtcagttcggactggggtctgcaacccgacctcaggaagctggattctctagtattcgagcatcagccatggcgcggtgaatacgttcccgggccttgtacaccccgcccgtcaagccatgaaagccgggggcgcctgaagtccgtgaacgggagggtcggcctagggtgaaaccggtgat

SEQ ID NO: 927 - DNA, 1457 bp, Artificial Sequence; identical to SEQ ID NO: 226
  Synthetic Polynucleotide

SEQ ID NO: 928 - DNA, 1398 bp, Artificial Sequence; identical to SEQ ID NO: 93
  Synthetic Polynucleotide

SEQ ID NO: 929 - DNA, 1405 bp, Artificial Sequence
  Synthetic Polynucleotide
agagtttgttcctggctcaggatgaacgctagcgacaggcctaacacatgcaagtcgaggggcagcggggaggtagcaatacctttgccggcgaccggcgcacgggtgagtaacacgtatgcaatccacctgtaacagggggataacccggagaaatccggactaataccccatgatatgggctctccgcatggagggtccattaaagagagcaatcttggttacagacgagcatgcgctccattagccagttggcggggtaacggcccaccaaggcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtgcgctacgcgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaatttccgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagatacccccggaatgtccacacagtaagagaggaattataactgtttgagatcacaatgtaagcggcacagcgaaagctgttaggtattccacttggggagtagcgcgggcacgggtgaaatctcaaagaaatgggcgggggccggcccaagcgaaggaccaggtggtttaattggatgataggggaggacctttaccggggtctgaaacagagggaagatttatgaaagaggatttccatcaagggtcagaaactaggtgctgcatggttgtcgtcagctcgtgccgtgaggtgtcggcttaagtgccataacgagcgcaacccctatggacagttactaacgggtgaagccgaggactctgtctagactgccggcgcaagccgcgaggaaggtggggatgacgtcaaatcagcacggcccttacgtccggggcgacacacgtgttacaatggcaggtacagaaggcagccagtcagcaatgacgcgcgaatcccgaaaacctgtctcagttcggattggagtctgcaacccgactccatgaagctggattcgctagtaatcgcgcatcagccatggcgcggtgaatacgttcccgggccttgcacacaccgcccgtca

SEQ ID NO: 930 - DNA, 1360 bp, Artificial Sequence
  Synthetic Polynucleotide
gatgaacgctagcgacaggcctaacacatgcaagtcgaggggcagcacagttgaagcttgcttcaatgggtggcgaccggcgcacgggtgagtaacgcgtatggaaccaacccgcaacagggggataacccggagaaatccggactaataccgcatagtacagggaatacagaagtattttttgttaaagagcaatcggttgcggacggtcatgcgttccattagctagttggcggggtaacggcccaccaaggcgacgatggataggggttctgagaggaaggtcccccacactggtactgagacacggaccagactcctacgggaggcagcagtgaggaatattggtcaatgggcgagagcctgaaccagccaagtcgcgtgagggaagacggccctatgggttgtaaacctcttttagatgagagtaaaggtatctacgtgtaggtatttgcaagtatcatcagaataagcatcggctaattccgtgccagcagccgcggtaatacggaagatgcgagcgttatccggatttattgggtttaaagggtgcgtaggcgggttgttaagtcagcggtgaaatgcatcagcttaactggtgaattgccattgaaactggcgaccttgagtgtagcggaagtatgcggaatgtgtggtgtagcggtgaaatgcatagatatcacgcagaactccgattgcgaaggcagcataccatactacaactgacgctgaagcacgaaagcgtgggtatcgaacaggattagataccctggtagtccacgcagtaaacgatgaatactaaccgtttgcgatagaatgtaagcggtagagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacaggggaatatataagaaattatatagccagcaatggtcgctgtcgaggtgctgcatggttgtcgtcagctcgtgccgtgaggtgtcggcttaagtgccataacgagcgcaacccttattgatagttactaacaggtaaagctgaggactctattgagactgccggcgtaagccgcgaggaaggtggggatgacgtcaaatcagcacggcccttacgtccggggcgacacacgtgttacaatggcggggacagagagcagccaggtggtgacaccgagctaatcccgaaaccctgtctcagttcggattggagtctgcaactcgactccatgaagctggattcgctagtaatcgcgcatcagccatggcgcggtgaatacgttcccgggcct

SEQ ID NO: 931 - DNA, 1398 bp, Artificial Sequence; identical to SEQ ID NO: 45
  Synthetic Polynucleotide

SEQ ID NO: 932 - DNA, 1398 bp, Artificial Sequence
  Synthetic Polynucleotide
agagtttgttcctggctcaggatgaacgctagcgacaggcctaacacatgcaagtcgaggggcagcggggaggtagcaatacctttgccggcgaccggcgcacgggtgagtaacacgtatgcaatccacctgtaacagggggataacccggagaaatccggactaataccccatgatatgggctctccgcatggagggtccattaaagagagcaatcttggttacagacgagcatgcgctccattagccagttggcggggtaacggcccaccaaggcgacgatggataggggttctgagaggaaggtcccccacattggaactgagacacggtccaaactcctacgggaggcagcagtgaggaatattggtcaatggtcggcagactgaaccagccaagtcgcgtgagggaagacggccctacgggttgtaaacctcttttgtcggagagtaaagtgcgctacgcgtagcgtattgcaagtatccgaagaaaaagcatcggctaactccgtgccagcagccgcggtaatacggaggatgcgagcgttatccggatttattgggtttaaagggtgcgtaggcggcacgccaagtcagcggtgaaatttccgggctcaacccggactgtgccgttgaaactggcgagctagagtgcacaagaggcaggcggaatgcgtggtgtagcggtgaaatgcatagatatcacgcagaaccccgattgcgaaggcagcctgctagggtgcgacagacgctgaggcacgaaagcgtgggtatcgaacaggattagataccctggtagtccacgcagtaaacgatgaatactaactgtttgcgatacaatgtaagcggtacagcgaaagcgttaagtattccacctggggagtacgccggcaacggtgaaactcaaaggaattgacgggggcccgcacaagcggaggaacatgtggtttaattcgatgatacgcgaggaaccatacccgggcttaaattgcaaatgaattatggggaaacccataggccgtaaggcatttgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggccgctacctggtgacaggatgccaatcccaaaaacctctctcagttcggatcgaagtctgcaacccgacttcgtgaagctggattcgctagtaatcgcgcatcagccatggcgcggtgaatacgttcccgggtcttgcacacaccgcccgtca

SEQ ID NO: 933 - DNA, 1388 bp, Artificial Sequence; identical to SEQ ID NO: 210
  Synthetic Polynucleotide

SEQ ID NO: 934 - DNA, 1398 bp, Artificial Sequence; identical to SEQ ID NO: 51
  Synthetic Polynucleotide

SEQ ID NO: 935 - DNA, 1452 bp, Artificial Sequence; identical to SEQ ID NO: 280
  Synthetic Polynucleotide

SEQ ID NO: 936 - DNA, 1441 bp, Artificial Sequence; identical to SEQ ID NO: 297
  Synthetic Polynucleotide

SEQ ID NO: 937 - DNA, 1449 bp, Artificial Sequence; identical to SEQ ID NO: 287
  Synthetic Polynucleotide

SEQ ID NO: 938 - DNA, 1438 bp, Artificial Sequence
  Synthetic Polynucleotide
  misc_feature (616)..(616): n is a, c, g, or t
gatgaacgctagcgacgggcctaacacatgcaagtccaggggcagcggagaggtagcaatacctttgccggcgaccggcgcacgggtgagtaacacgtatgcaatccacctgtaacagggggataacccggagaaatccggactaataccccataatatgggcgctccgcatggagagcccattaaagagagcaattttggttacagacgatcatgcgctccattagccagttggcggggtaacggcccaccaaaacgacgatggataggggttctgagaggaaggtcccccacattgcaactgacacaccgtccacactcctacgggaggcagcagtgaggaatattggtcaatggtcggcagactgaaccagccaagtcgcgtgagggaagacggccctacgggttgtaaacctcttttgtcggagagtaaagtacgctacgtgtagcgtattgcaagtatccgaaaaaaaagcatcggctaactccgtgccagcagccgtggtaatacggaggatgcgagcgttatccggatttattgggtttaaagggtgcgtaggcggcacgccaagtcagcggtgaaatttccgggctcaacccggagtgtgccgttganactggcgagctagagtacacaagaggcaggcggaatgcgtggtgtagcggtgaaatgcatacatatcacgcagaaccccgattgcgaaggcagcctgctagggtgaaacagacgctgaggcacgtaagcgtgggtttcgcacaggatttagataccttggtagtcctcgcagtaatcgatgaaatattatctgtttgcgatacaatgtaagcggtacagcgaaagcgttaagtattccacctggggagtatgccggcaacggtgaaactcaaaggaattgacgggggcccgcacaagcggaggaacatgtggtttaattcgatgatacgcgaggagccttatcccgggctcaaacgcagggggaatatatatgaaagtatatagctagcaatagtcacttgcgaggtgctgcatggttgtcgtcagctcgtgccgtgaggtgtcggcttaagtgccataacgagcgcaacccctatggacagttactaacgggtgaagccgaggactctgtcgagactgccggcgcaagccgcgaggaaggtggggatgacgtcaaatcagcacggcccttacgtccggggtgacccacgcgttacaatggcaggtacatgaaggcagccagtcagcaatgacgcgcgaatcccgaaaacctgtttcagttcggattggagtttgcaacccgactccatgaaggtggattcgctagtaatcgcgcatcagccatggcgcggtgaatacgtttccgggccttgtacacaccgcccgtcaagccatggaagccgggagtacctaaagcatgcaaccgcaaggagcgtacgaagg

SEQ ID NO: 939 - DNA, 1442 bp, Artificial Sequence; identical to SEQ ID NO: 284
  Synthetic Polynucleotide

SEQ ID NO: 940 - DNA, 1491 bp, Artificial Sequence
  Synthetic Polynucleotide
agagtttgatcctggctcaggatgaacgctagcgacaggcctaacacatgcaagtcgaggggcagcgcggaggtagcaatacttttggcggcgaccggcgcgcgggtgagtaacacgtatgcaatctgcctgtaacagggggataacccggagaaatccggcctaataccccataacgacgggagcccgcatgggcattcgtctaaagagagcaatcttggttacagatgagcatgcggtccattagccagttggcggggtaacggcccaccaaagcgacgatggataggggttctgagaggaaggtcccccacattggaactgagacacggtccaaactcctacgggaggcagcagtgaggaatattggtcaatggtcggcagactgaaccagccaagtcgcgtgaaggaagacggccctacgggttgtaaacttcttttgtcggagagtaaaggtcttcacgagtggagatttgcaagtatccgaagaaaaagcatcggctaactccgtgccagcagccgcggtaatacggaggatgcgagcgttatccggatttattgggtttaaagggtgcgtaggcggcacatcaagtcagcggtgaaatgcccgggcttaacccgggagctgccgttgaaactggcgagctagcgtgcacaagaggtaggcggaatgcgtggtgtagcggtgaaatgcatagatatcacgaagaaccccgattgcgaaggcagcctgctaagctgcaactgacgttgaggctcgaaagtgtgggtatcaaacaggattagataccctggtagtccacacggtaaacgatggatactcgctgttggcgatatacagtcagcggccaagtgaaaacgttaagtatcccacctggggagtacgccggcaacggtgaaactcaaaggaattgacgggggcccgcacaagcggaggaacatgtggtttaattcgatgatacgcgaggaaccttacccgggcttgaactgcacccgaatttaccggagacggtaaagccgcaaggcgggtgtggaggtgctgcatggttgtcgtcagctcgtgccgtgaggtgtcggcttaagtgccataacgagcgcaaccctttccgccggttactaacaggtcatgctgaggactccgacggtactgccatcgtaagatgtgaggaaggtggggatgacgtcaaatcagcacggcccttacgtccggggctacacacgtgttacaatggggggtacagaaggcagcgacctggcgacagggagcgaatcccgaaagcccctctcagttcggactggagtctgcaacccgactccacgaagctggattcgctagtaatcgcgcatcagccacggcgcggtgaatacgttcccgggccttgtacacaccgcccgtcaagccatgaaagccgggggtacctgaagtgcgtaaccgcgaggagcgccctagggtaaaaccggtaattggggctaagtcgtaacaaggtaacc

SEQ ID NO: 941 - DNA, 1378 bp, Artificial Sequence; identical to SEQ ID NO: 214
  Synthetic Polynucleotide

SEQ ID NO: 942 - DNA, 1445 bp, Artificial Sequence; identical to SEQ ID NO: 248
  Synthetic Polynucleotide

SEQ ID NO: 943 - DNA, 1451 bp, Artificial Sequence; identical to SEQ ID NO: 306
  Synthetic Polynucleotide

SEQ ID NO: 944 - DNA, 1400 bp, Artificial Sequence; identical to SEQ ID NO: 88
  Synthetic Polynucleotide

What is claimed is:

1. A method of treating an Enterococcal blood stream infection in a subject who has received or is receiving an anti-cancer therapy, the method comprising administering to the subject a pharmaceutical composition comprising a purified bacterial strain, wherein the bacterial strain comprises a 16S rRNA sequence that is at least 97% identical to a nucleotide sequence of SEQ ID NO: 621 or SEQ ID NO: 756.

2. The method of claim 1, wherein the anti-cancer therapy is selected from surgery, radiation therapy, chemotherapy and targeted therapy.

3. The method of claim 2, wherein the anti-cancer therapy is chemotherapy.

4. The method of claim 2, wherein the anti-cancer therapy is targeted therapy.

5. The method of claim 4, wherein the targeted therapy is immunotherapy.

6. The method of claim 1, wherein the pharmaceutical composition is administered to the subject before the anti-cancer therapy.

7. The method of claim 1, wherein the pharmaceutical composition is administered to the subject contemporaneously with the anti-cancer therapy.

8. The method of claim 1, wherein the pharmaceutical composition is administered to the subject after the anti-cancer therapy.

9. The method of claim 1, wherein the subject is at risk of developing a bloodstream infection due to treatment with the anti-cancer therapy.

10. The method of claim 1, wherein the purified bacterial strain has a cytotoxic or cytostatic effect on extended spectrum beta-lactam resistant Enterococci (ESBL) and/or vancomycin-resistant Enterococci (VRE).

11. The method of claim 1, wherein the pharmaceutical composition further comprises a bacterial strain selected based on production by the bacterial strain of a product that treats a gut dysbiosis disorder.

12. The method of claim 11, wherein the product is a secreted product, which is a short-chain fatty acid (SOFA).

13. The method of claim 12, wherein the SOFA is selected from formic acid, acetic acid, propionic acid, butyric acid, isobutyric acid, valeric acid, isovaleric acid, and a combination thereof.

14. The method of claim 1, wherein the purified bacterial strain prevents thinning of the mucus layer and/or prevents entry of toxic metabolites and bacterial byproducts into the bloodstream, thereby decreasing a source of chronic inflammation.

15. The method of claim 1, wherein the bacterial strain comprises a 16S rRNA sequence that is at least 99% identical to a nucleotide sequence of SEQ ID NO: 621 or SEQ ID NO: 756.

* * * * *